US007858848B2

(12) United States Patent
Reuber et al.

(10) Patent No.: US 7,858,848 B2
(45) Date of Patent: *Dec. 28, 2010

(54) TRANSCRIPTION FACTORS FOR INCREASING YIELD

(75) Inventors: T. Lynne Reuber, San Mateo, CA (US); Oliver Ratcliffe, Oakland, CA (US); Jacqueline Heard, Webster Groves, MO (US); Jose Luis Riechmann, Barcelona (ES); Omaira Pineda, Vero Beach, FL (US); Luc Adam, Hayward, CA (US)

(73) Assignee: Mendel Biotechnology Inc., Hayward, CA (US)

( * ) Notice: Subject to any disclaimer, the term of this patent is extended or adjusted under 35 U.S.C. 154(b) by 242 days.

This patent is subject to a terminal disclaimer.

(21) Appl. No.: 11/479,226

(22) Filed: Jun. 30, 2006

(65) Prior Publication Data

US 2007/0022495 A1 Jan. 25, 2007

Related U.S. Application Data

(63) Continuation-in-part of application No. 09/713,994, filed on Nov. 16, 2000, now abandoned.

(60) Provisional application No. 60/166,228, filed on Nov. 17, 1999, provisional application No. 60/197,899, filed on Apr. 17, 2000, provisional application No. 60/227,439, filed on Aug. 22, 2000.

(51) Int. Cl.
C12N 15/82 (2006.01)
A01H 5/00 (2006.01)
A01H 5/10 (2006.01)

(52) U.S. Cl. .................. 800/298; 800/278; 800/279; 800/287

(58) Field of Classification Search ................ None
See application file for complete search history.

(56) References Cited

U.S. PATENT DOCUMENTS

| 5,891,859 | A | 4/1999 | Thomashow et al. |
| 5,892,009 | A | 4/1999 | Thomashow et al. |
| 5,939,601 | A | 8/1999 | Klessig et al. |
| 6,077,994 | A | 6/2000 | Coupland et al. |
| 6,093,874 | A | 7/2000 | Jofuku et al. |
| 6,121,513 | A | 9/2000 | Zhang et al. |
| 6,329,567 | B1 | 12/2001 | Jofuku et al. |
| 6,417,428 | B1 | 7/2002 | Thomashow et al. |
| 6,664,446 | B2 * | 12/2003 | Heard et al. ............... 800/301 |
| 7,238,860 | B2 | 12/2003 | Ratcliffe et al. |
| 6,706,866 | B1 | 3/2004 | Thomashow et al. |
| 6,717,034 | B2 | 4/2004 | Jiang |
| 6,835,540 | B2 | 12/2004 | Broun |
| 6,846,669 | B1 | 1/2005 | Jofuku et al. |
| 6,946,586 | B1 | 9/2005 | Fromm et al. |
| 7,109,393 | B2 | 9/2006 | Gutterson et al. |
| 7,135,616 | B2 | 11/2006 | Heard et al. |
| 7,196,245 | B2 | 2/2007 | Jiang et al. |
| 7,223,904 | B2 | 5/2007 | Heard et al. |
| 7,345,217 | B2 | 3/2008 | Zhang et al. |
| 2002/0023281 | A1 | 2/2002 | Gorlach et al. |
| 2002/0088022 | A1 | 7/2002 | Harris et al. |
| 2002/0138882 | A1 | 9/2002 | Cahoon et al. |
| 2003/0093837 | A1 | 5/2003 | Keddie et al. |
| 2003/0121070 | A1 | 6/2003 | Adam et al. |
| 2003/0217383 | A1 | 11/2003 | Reuber et al. |
| 2003/0233670 | A1 | 12/2003 | Edgerton et al. |
| 2003/0233680 | A1 | 12/2003 | Thomashow et al. |
| 2004/0019927 | A1 | 1/2004 | Sherman et al. |
| 2004/0031072 | A1 | 2/2004 | La Rosa et al. |
| 2004/0034888 | A1 | 2/2004 | Liu et al. |
| 2004/0123343 | A1 | 6/2004 | La Rosa et al. |
| 2004/0128712 | A1 | 7/2004 | Jiang et al. |
| 2004/0214272 | A1 | 10/2004 | La Rosa et al. |
| 2004/0216190 | A1 | 10/2004 | Kovalic et al. |
| 2005/0086718 | A1 | 4/2005 | Heard et al. |
| 2005/0097638 | A1 | 5/2005 | Jiang et al. |
| 2005/0155117 | A1 | 7/2005 | Century et al. |
| 2005/0172364 | A1 | 8/2005 | Heard |
| 2006/0008874 | A1 | 1/2006 | Creelman et al. |
| 2006/0015972 | A1 | 1/2006 | Heard et al. |
| 2006/0162018 | A1 | 7/2006 | Gutterson et al. |
| 2006/0195944 | A1 | 8/2006 | Heard et al. |
| 2006/0242738 | A1 | 10/2006 | Sherman et al. |
| 2006/0272060 | A1 | 11/2006 | Heard et al. |

(Continued)

FOREIGN PATENT DOCUMENTS

| DE | 19503359 | 2/1996 |
| EP | 0803572 | 10/1997 |
| EP | 0969092 | 5/2000 |
| EP | 1033405 | 9/2000 |

(Continued)

OTHER PUBLICATIONS

Yang et al (2001, PNAS 98(20):11438-11443).*
Riechmann et al (2000, Current Opinion in Plant Biology 3:423-434).*
Bowie et al, Science 247:1306-1310, 1990.*
McConnell et al, Nature 411 (6838):709-713, 2001.*
Lai et al (2008, BMC Plant Biology 8, Article No. 8, pp. 1-13).*
U.S. Appl. No. 12/064,961, Gutterson, N. et al. SEQ 221, 222, entire document.
U.S. Appl. No. 12/077,535, Repetti, P. et al. SEQ 401, 402, entire document.

(Continued)

Primary Examiner—Stuart F. Baum
(74) Attorney, Agent, or Firm—Jeffery M. Libby; Yifan Mao

(57) ABSTRACT

The invention is directed to transgenic plants transformed with nucleic acids that encode a plant transcription factor that increases the transgenic plant's size and yield and/or delays flowering in the plant, and methods of using and producing the transgenic plants.

25 Claims, 4 Drawing Sheets

U.S. PATENT DOCUMENTS

Figure 1:
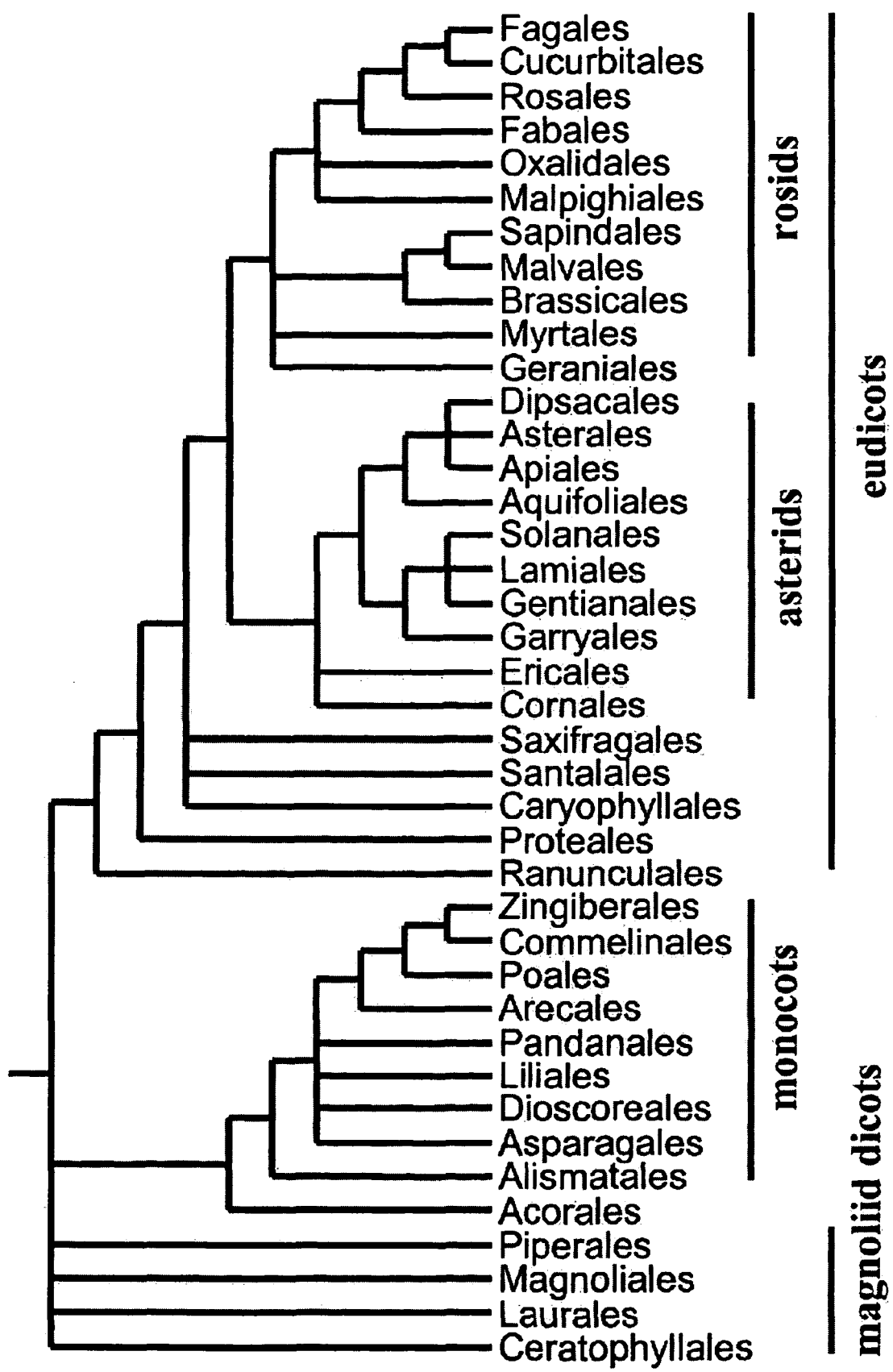

| | | | |
|---|---|---|---|
| 2007/0022495 | A1 | 1/2007 | Reuber et al. |
| 2007/0101454 | A1 | 5/2007 | Jiang et al. |
| 2007/0186308 | A1 | 8/2007 | Reuber et al. |
| 2007/0199107 | A1 | 8/2007 | Ratcliffe et al. |
| 2007/0209086 | A1 | 9/2007 | Ratcliffe et al. |
| 2007/0226839 | A1 | 9/2007 | Gutterson et al. |
| 2008/0010703 | A1 | 1/2008 | Creelman et al. |
| 2008/0155706 | A1 | 6/2008 | Riechmann et al. |
| 2008/0163397 | A1 | 7/2008 | Ratcliffe et al. |
| 2008/0229448 | A1 | 9/2008 | Libby et al. |

FOREIGN PATENT DOCUMENTS

| | | |
|---|---|---|
| JP | 2005-013214 | 1/2005 |
| WO | WO9632007 | 10/1996 |
| WO | WO9724449 | 7/1997 |
| WO | WO9747183 | 12/1997 |
| WO | WO9807842 | 2/1998 |
| WO | WO9837184 | 8/1998 |
| WO | WO9837755 | 9/1998 |
| WO | WO98048007 | 10/1998 |
| WO | WO98/58069 | 12/1998 |
| WO | WO9924573 | 5/1999 |
| WO | WO9938977 | 8/1999 |
| WO | WO9941974 | 8/1999 |
| WO | WO9953016 | 10/1999 |
| WO | WO9955840 | 11/1999 |
| WO | WO0032761 | 6/2000 |
| WO | WO0046383 | 8/2000 |
| WO | WO0053724 | 9/2000 |
| WO | WO0070059 | 11/2000 |
| WO | WO0125458 | 4/2001 |
| WO | WO0149840 | 7/2001 |
| WO | WO0208410 | 1/2002 |
| WO | WO0208411 | 1/2002 |
| WO | WO0215675 A1 | 2/2002 |
| WO | WO0216655 | 2/2002 |
| WO | WO0222675 | 3/2002 |
| WO | WO02079245 A | 10/2002 |
| WO | WO03000898 | 1/2003 |
| WO | WO03008540 | 1/2003 |
| WO | WO03013227 A2 | 2/2003 |
| WO | WO03014327 A2 | 2/2003 |
| WO | WO03020936 | 3/2003 |
| WO | WO03044190 | 5/2003 |
| WO | WO03048319 | 6/2003 |
| WO | WO03081978 | 10/2003 |
| WO | WO03097790 | 11/2003 |
| WO | WO2004029222 | 4/2004 |
| WO | WO2004031349 | 4/2004 |
| WO | WO2004035798 | 4/2004 |
| WO | WO2004076638 | 9/2004 |
| WO | WO2004087878 | 10/2004 |
| WO | WO2005001050 | 1/2005 |
| WO | WO2005047516 A2 | 5/2005 |
| WO | WO2006033708 A2 | 3/2006 |
| WO | WO2006069201 A2 | 6/2006 |
| WO | WO2006130156 A2 | 12/2006 |
| WO | WO2007028165 A2 | 3/2007 |
| WO | WO2007127186 A2 | 11/2007 |

OTHER PUBLICATIONS

U.S. Appl. No. 11/981,576, Gutterson, N. et al. SEQ 1, 2, entire document.

U.S. Appl. No. 11/632,390, Zhang, James et al. SEQ 249, 250, entire document.

NCBI acc. No. AAB38748 (gi: 1732406) (Dec. 16, 1996); Xu,P., et al. "Direct Submission" (Submitted(Dec. 6, 1996) Biotechnology Institute, Zhejiang Agriculture Unversity, Hangzhou, Zhejiang 310029, P.R.China).

NCBI acc. No. AAC14323 (gi: 3065895) (Apr. 21, 1998); Park,J.M., et al. "TSI1 [*Nicotiana tabacum*]"; source:*Nicotiana tabacum* (common tobacco); Title: "Direct Submission" (Submitted (Apr. 10, 1998) Graduate School of Biotechnology, Korea University, 1,5-Ka Anamdong, Sungbuk-ku, Seoul 136-701, Korea).

NCBI acc. No. AAC24587 (gi: 3264767) (Jun. 28, 1998); Mbeguie-A-Mbeguie.D., et al. "AP2 domain containing protein [*Prunus armeniaca*]"; source: *Prunus armeniaca* (apricot); Title: "Molecular cloning and partial nucleotide sequence of an AP2 domain containing protein from apricot" (Unpublished).

NCBI acc. No. AAC29516 (gi: 1688233) (Nov. 28, 1996); Stidd,J.E., et al. "DNA binding protein homolog [*Solanum tuberosum*]"; source: *Solanum tuberosum* (potato); Title: "cDNA sequence from a logphase cell suspension culture with similarity to DNA binding proteins" (Unpublished).

NCBI acc. No. AAC49740(gi: 2213783) (Jun. 25, 1997); Zhou,J., et al. "Pti5 [*Lycopersicon esculentum*]"; source: *Lycopersicon esculentum* (tomato).

NCBI acc. No. AAC49741 (gi: 2213785) (Jun. 25, 1997); Zhou,J., et al. "Pti6 [*Lycopersicon esculentum*]"; source: *Lycopersicon esculentum* (tomato).

NCBI acc. No. AAC50047 (gi: 2213781) (Jun. 25, 1997); Zhou,J., et al. "Pti4 [*Lycopersicon esculentum*]"; source: *Lycopersicon esculentum* (tomato).

NCBI acc. No. AAC62619 (gi: 3695034) (Oct. 6, 1998); Horvath,D. M., et al. "ethylene response element binding protein 1 [*Nicotiana tabacum*]"; source: *Nicotiana tabacum* (common tobacco); Title: "Four classes of salicylate-induced tobacco genes" (Mol. Plant Microbe Interact. 11 (9), 895-905 (1998)).

NCBI acc. No. AAD00708 (gi: 4099914) (Jan. 5, 1999); Gardner,R. C., et al. "ethylene-responsive element binding protein homolog [*Stylosanthes hamata*]"; source: *Stylosanthes hamata*; Title: "Aluminium Tolerance in Yeast Conferred by Over-expression of Stylosanthes genes" (Unpublished).

NCBI acc. No. AAD09248 (gi: 4099921) (Jan, 5, 1999); Gardner,R. C., et al. "EREBP-3 homolog [*Stylosanthes hamata*]"; source: *Stylosanthes hamata*; Title: "Aluminium Tolerance in Yeast Conferred by Over-expression of Stylosanthes Genes" (Unpublished).

NCBI acc. No. AAF05606 (gi: 6176534) (Nov. 2, 1999); Cao,Z.F., et al. "EREBP-like protein [*Oryza sativa*]"; source: *Oryza sativa* (japonica cultivar-group); Title: "Characterization of a rice cDNA encoding an EREBP-like protein induced by ethylene" (Unpublished).

NCBI acc. No. AAF23899 (gi: 6689918) (Jan. 11, 2000); Cheong,Y. H., et al. "transcription factor EREBP1 [*Oryza sativa*]"; source: *Oryza sativa*; Title: "A plant novel MAP kinase, RMAPK1, phosphorylates defense-related transcription factor" (Unpublished).

NCBI acc. No. AAF63205 (gi: 7528276) (Apr. 9, 2000); Scharte,J., et al. "AP2-related transcription factor [*Mesembryanthemum crystallinum*]"; source: *Mesembryanthemum crystallinum* (common iceplant).

NCBI acc. No. AAF76898 (gi: 8571476) (Jun. 18, 2000); Shen,Y., et al. "apetala2 domain-containing protein [*Atriplex hortensis*]"; source: *Atriplex hortensis*.

NCBI acc. No. AAG43545 (gi: 12003376) (Jan. 2, 2001); Durrant,W. E., et al. "Avr9/Cf-9 rapidly elicited protein 1 [*Nicotiana tabacum*]"; source: *Nicotiana tabacum* (common tobacco).

NCBI acc. No. AAG49031 (gi: 12231294) (Jan. 16, 2001); Giovannoni,J.J., et al. "ripening regulated protein DDTFR 10/A [*Lycopersicon esculentum*]"; source: *Lycopersicon esculentum* (*Solanum lycopersicum*).

NCBI acc. No. AAG60182 (gi: 12597874) (Jan. 30, 2001); Buell,C. R., et al. "putative ethylene-responsive element binding protein [*Oryza sativa*]"; source: *Oryza sativa*.

NCBI acc. No. AAK31279 (gi: 13569995) (Apr. 10, 2001); Buell,C. R., et al. "putative ethylene-responsive element binding protein [*Oryza sativa*]"; source: *Oryza sativa*.

NCBI acc. No. AAK52110 (gi: 14018047) (May 11, 2001); Nascimento,L.U., et al. "Putative protein containing AP2 DNA binding domain [*Oryza sativa*]"; source: *Oryza sativa*; Title: "Genomic Sequence for *Oryza sativa*, Nipponbare Strain, Chromosome X, Clone OSJNBb0061118, Complete Sequence" (Unpublished).

NCBI acc. No. AAK92632 (gi: 15217288) (Aug. 21, 2001); Spiegel,L., et al. "Putative EREBP-like protein [*Oryza sativa*]"; source: *Oryza sativa* (japonica cultivar-group); Title: "Genomic Sequence for *Oryza sativa*, Nipponbare strain, clone OSJNBa0032G08, from Chromosome 3, complete sequence" (Unpublished).

NCBI acc. No. AAK92633 (gi: 15217289) (Aug. 21, 2001); Spiegel,L., et al. "Putative AP2 domain containing transcription factor [*Oryza sativa*]"; source: *Oryza sativa* (japonica cultivar-group); Title: "Genomic Sequence for Oryza sativa, Nipponbare strain, clone OSJNBa0032G08, from Chromosome 3, complete sequence".

NCBI acc. No. AAK92635 (gi: 15217291) (Aug. 21, 2001); Spiegel,L., et al. "Putative AP2 domain containing protein [*Oryza sativa*]"; source: *Oryza sativa* (japonica cultivar-group); Title: "Genomic Sequence for *Oryza sativa*, Nipponbare strain, clone OSJNBa0032G08, from Chromosome 3, complete sequence" (Unpublished).

NCBI acc. No. AAK92636 (gi: 15217292) (Aug. 21, 2001); Spiegel,L., et al. "Putative AP2 domain containing protein [*Oryza sativa*]"; source: *Oryza sativa* (japonica cultivar-group); Title: "Genomic Sequence for *Oryza sativa*, Nipponbare strain, clone OSJNBa0032G08, from Chromosome 3, complete sequence" (Unpublished).

NCBI acc. No. AB016264 (gi: 8809570) (Jun. 28, 2000); Kitajima,S., et al. "*Nicotiana sylvestris* nserf2 gene for ethylene-responsive element binding factor, complete cds"; source: *Nicotiana sylvestris* (wood tobacco).

NCBI acc. No. AB016266 (gi: 8809574) (Jun. 28, 2000); Kitajima,S., et al. "*Nicotiana sylvestris* nserf4 gene for ethylene-responsive element binding factor, complete cds"; source: *Nicotiana sylvestris* (wood tobacco).

NCBI acc. No. AB018117 (gi: 3702735) (Oct. 6, 1998); Nakamura,Y., et al. "*Arabidopsis thaliana* strain Columbia chromosome 5 clone MQL5, * Sequencing in Progress *"; source: *Arabidopsis thaliana* (thale cress); Title: "Structural Analysis of *Arabidopsis thaliana* Chromosome 5. IX" (Unpublished (1998)).

NCBI acc. No. AB025608 (gi: 4589414) (Apr. 20, 1999); Nakamura,Y., et al. "*Arabidopsis thaliana* genomic DNA, chromosome 3, TAC clone: K13B15, complete sequence"; source: *Arabidopsis thaliana* (thale cress); Title: "Structural Analysis of *Arabidopsis thaliana* Chromosome 3. II" (Unpublished (1999)).

NCBI accession. No. AB025628 (gi:4589434) (pos. 69357-69929) (Apr. 20, 1999); Nakamura,Y., "*Arabidopsis thaliana* genomic DNA, chromosome 5, P1 clone: MNJ7, complete sequence".

NCBI acc. No. AB035270 (gi: 6478844) (Nov. 30, 1999); Ashida,Y., et al. "*Matricaria chamomilla* McEREBP1 mRNA for ethylene-responsive element binding protein1 homolog, partial cds"; source: *Matricaria chamomilla*.

NCBI acc. No. AC025907 (gi: 7249444) (Mar. 16, 2000); Llaca,V., et al. "*Oryza sativa* chromosome 10 clone nbxb0094K20, * Sequencing in Progress *, 2 ordered pieces"; source: *Oryza sativa*; Title: "Rice Chromosome 10" (Unpublished).

NCBI acc. No. AC079890 (gi: 10179366) (Sep. 16, 2000); Buell,R., et al. "*Oryza sativa* chromosome 10 clone OSJNBb0089A17, * Sequencing in Progress *, 12 unordered pieces"; source: *Oryza sativa*; Title: "*Oryza sativa* ssp. japonica cv. Nipponbare OSJNBb0089A17 BAC genomic sequence" (Unpublished).

NCBI acc. No. AC084763 (gi: 11178087) (Nov. 15, 2000); Buell,R., et al. "*Oryza sativa* chromosome 10 clone OSJNBa0027P10, * Sequencing in Progress *, 9 unordered pieces"; source: *Oryza sativa*; Title: "*Oryza sativa* ssp. japonica cv. Nipponbare OSJNBa0027P10 BAC genomic sequence" (Unpublished).

NCBI acc. No. AF057373 (gi: 3695033) (Oct. 6, 1998); Horvath,D. M., et al. "*Nicotiana tabacum* ethylene response element binding protein 1 (EREBP1) mRNA, EREBP1-2 allele, partial cds"; source: *Nicotiana tabacum* (common tobacco).

NCBI acc. No. AF204784 (gi: 12231293) (Jan. 16, 2001); Giovannoni,J.J., et al. "*Lycopersicon esculentum* ripening regulated protein DDTFR10/A (DDTFR10/A) mRNA, partial cds"; source: *Lycopersicon esculentum* (Solanum lycopersicum).

NCBI acc. No. AF211527 (gi: 12003375) (Jan. 2, 2001); Durrant,W. E., et al. "*Nicotiana tabacum* Avr9/Cf-9 rapidly elicited protein 1 (ACRE1) mRNA, complete cds"; source: *Nicotiana tabacum* (common tobacco).

NCBI acc. No. AF245119 (gi: 7528275) (Apr. 9, 2000); Scharte,J., et al. "*Mesembryanthemum crystallinum* AP2 -related transcription factor (CDBP) mRNA, complete cds"; source: *Mesembryanthemum crystallinum* (common iceplant).

NCBI acc. No. AI440657 (gi: 4283446) (Feb. 19, 1999); Shoemaker,R., et al. "sa63d09.y1 Gm-c1004 Glycine max cDNA clone Genome Systems Clone Id: Gm-c1004-3978 5' similar to TR:Q40476 Q40476 EREBP-1. ; , mRNA sequence"; source: *Glycine max* (soybean).

NCBI acc. No. AI442716 (gi: 4298124) (Feb. 19, 1999); Shoemaker,R., et al. "sa85d10.y1 Gm-c1004 Glycine max cDNA clone Genome Systems Clone Id: Gm-c1004-6092 5' similar to TR:O04680 O04680 PTI4. ;, mRNA sequence"; source: *Glycine max* (soybean); Title: "Public Soybean EST Project" (Unpublished (1999)).

NCBI acc. No. AI483782 (gi: 4387706) (Mar. 9, 1999); Alcala,J., et al. "EST249653 tomato ovary, TAMU *Lycopersicon esculentum* cDNA clone cLED23P13, mRNA sequence"; source: *Lycopersicon esculentum* (Solanum lycopersicum); Title: "Generation of ESTs from tomato carpel tissue" (Unpublished (1999)).

NCBI acc. No. AI483900 (gi: 4387824) (Mar. 9, 1999); Alcala,J., et al. "EST249771 tomato ovary, TAMU *Lycopersicon esculentum* cDNA clone cLED24L7, mRNA sequence"; source: *Lycopersicon esculentum* (Solanum lycopersicum); Title: "Generation of ESTs from tomato carpel tissue" (Unpublished (1999)).

NCBI acc. No. AI484961 (gi: 4380332) (Mar. 9, 1999); Alcala.J., et al. "EST243224 tomato ovary, TAMU *Lycopersicon esculentum* cDNA clone cLED2F21, mRNA sequence"; source: *Lycopersicon esculentum* (Solanum lycopersicum); Title: "Generation of ESTs from tomato carpel tissue" (Unpublished (1999)).

NCBI acc. No. AI485175 (gi: 4380546) (Mar. 9, 1999); Alcala.J., et al. "EST243479 tomato ovary, TAMU *Lycopersicon esculentum* cDNA clone cLED6D8, mRNA sequence"; source: *Lycopersicon esculentum* (Solanum lycopersicum); Title: "Generation of ESTs from tomato carpel tissue" (Unpublished (1999)).

NCBI acc. No. AI486689 (gi: 4382060) (Mar. 9, 1999); Alcala.J., et al. "EST245011 tomato ovary, TAMU *Lycopersicon esculentum* cDNA clone cLED11H4, mRNA sequence"; source: *Lycopersicon esculentum* (Solanum lycopersicum); Title: "Generation of ESTs from tomato carpel tissue" (Unpublished (1999)).

NCBI acc. No. AI487067 (gi: 4382438) (Mar. 9, 1999); Alcala.J., et al. "EST245389 tomato ovary, TAMU *Lycopersicon esculentum* cDNA clone cLED9C13, mRNA sequence"; source: *Lycopersicon esculentum* (Solanum lycopersicum); Title: "Generation of ESTs from tomato carpel tissue" (Unpublished (1999)).

NCBI acc. No. AI489709 (gi: 4385080) (Mar. 9, 1999); Alcala.J., et al. "EST248048 tomato ovary, TAMU *Lycopersicon esculentum* cDNA clone cLED14L13, mRNA sequence"; source: *Lycopersicon esculentum* (Solanum lycopersicum); Title: "Generation of ESTs from tomato carpel tissue" (Unpublished (1999)).

NCBI acc. No. AI495036 (gi: 4396039) (Mar. 11, 1999); Shoemaker,R., et al. "sa90a09.y1 Gm-c1004 *Glycine max* cDNA clone Genome Systems Clone Id: Gm-c1004-6545 5' similar to Tr:O22167 O22167 EREBP Isolog. ;, mRNA sequence"; source: *Glycine max* (soybean).

NCBI acc. No. AI496139 (gi: 4397142) (Mar. 11, 1999); Shoemaker,R., et al. "sa95h06.y1 Gm-c1004 *Glycine max* cDNA Clone Genome Systems Clone Id: Gm-c1004-7092 5' similar to SW:CDI3_ARATH P42736 Cadmium-Induced Protein AS30. ;, mRNA sequence"; source: *Glycine max* (soybean).

NCBI acc. No. AI771213 (gi: 5269350) (Jun. 29, 1999); Alcala.J., et al. "EST252409 tomato ovary, TAMU *Lycopersicon esculentum* cDNA clone cLED29K9, mRNA sequence"; source: *Lycopersicon esculentum* (Solanum lycopersicum); Title: "Generation of ESTs from tomato carpel tissue" (Unpublished (1999)).

NCBI acc. No. AI776626 (gi: 5274667) (Jun. 29, 1999); D Ascenzo,M., et al. "EST257726 tomato resistant, Cornell *Lycopersicon esculentum* cDNA clone cLER19A14, mRNA sequence"; source: *Lycopersicon esculentum* (*Solanum lycopersicum*).

NCBI acc. No. AI778693 (gi: 5276734) (Jun. 29, 1999); D Ascenzo,M., et al. "EST259572 tomato susceptible, Cornell *Lycopersicon esculentum* cDNA clone cLES6I9, mRNA sequence"; source: *Lycopersicon esculentum* (*Solanum lycopersicum*).

NCBI acc. No. AI781904 (gi: 5279945) (Jun. 29, 1999); D Ascenzo,M., et al. Title: "Generation of ESTs from *Pseudomonas* susceptible tomato" (Unpublished (1999)).

NCBI acc. No. AI782381 (gi: 5280422) (Jun. 29, 1999); D Ascenzo,M., et al. "EST263260 tomato susceptible, Cornell *Lycopersicon esculentum* cDNA clone cLES18P16, mRNA sequence"; source: *Lycopersicon esculentum* (*Solanum lycopersicum*).

NCBI acc. No. AI794657 (gi: 5342373) (Jul. 2, 1999); Shoemaker,R., et al. "sb67b03.y1 Gm-c1019 *Glycine max* cDNA clone Genome Systems Clone Id: Gm-c1019-6 5' similar to TR:Q40478 Q40478 EREBP-4. ;, mRNA sequence"; source: *Glycine max* (soybean); Title: "Public Soybean EST Project" (Unpublished (1999)).

NCBI acc. No. AI894873 (gi: 5600775) (Jul. 27, 1999); Alcala,J., et al. "EST264316 tomato callus, TAMU *Lycopersicon esculentum* cDNA clone cLEC6K7, mRNA sequence"; source: *Lycopersicon esculentum* (*Solanum lycopersicum*); Title: "Generation of ESTs from tomato callus tissue" (Unpublished (1999)).

NCBI acc. No. AI896308 (gi: 5602210) (Jul. 27, 1999); Alcala,J., et al. "EST265751 tomato callus, TAMU *Lycopersicon esculentum* cDNA clone cLEC14N19, mRNA sequence"; source: *Lycopersicon esculentum* (*Solanum lycopersicum*); Title: "Generation of ESTs from tomato callus tissue" (Unpublished (1999)).

NCBI acc. No. AI897797 (gi: 5603699) (Jul. 27, 1999); Alcala,J., et al. "EST267240 tomato ovary, TAMU *Lycopersicon esculentum* cDNA clone cLED30P1, mRNA sequence"; source: *Lycopersicon esculentum* (*Solanum lycopersicum*); Title: "Generation of ESTs from tomato carpel tissue" (Unpublished (1999)).

NCBI acc. No. AI897834 (gi: 5603736) (Jul. 27, 1999); Alcala,J., et al. "EST267277 tomato ovary, TAMU *Lycopersicon esculentum* cDNA clone cLED30F18, mRNA sequence"; source: *Lycopersicon esculentum* (*Solanum lycopersicum*); Title: "Generation of ESTs from tomato carpel tissue" (Unpublished (1999)).

NCBI acc. No. AI899000 (gi: 5604902) (Jul. 27, 1999); Alcala,J., et al. "EST268443 tomato ovary, TAMU *Lycopersicon esculentum* cDNA clone cLED36J9, mRNA sequence"; source: *Lycopersicon esculentum* (*Solanum lycopersicum*); Title: "Generation of ESTs from tomato carpel tissue" (Unpublished (1999)).

NCBI acc. No. AI899889 (gi: 5605791) (Jul. 27, 1999); Shoemaker,R., et al. "sb94g05.y1 Gm-c1017 Glycine max cDNA clone Genome Systems Clone Id: Gm-c1017-1137 5' similar to TR:Q40478 Q40478 EREBP-4. ; , mRNA sequence"; source: *Glycine max* (soybean).

NCBI acc. No. AI965917 (gi: 5760554) (Aug. 23, 1999); Shoemaker,R., et al. Title: "Public Soybean EST Project" (Unpublished (1999)).

NCBI acc. No. AI967551 (gi: 5762854) (Aug. 24, 1999); Poulsen,C., et al. Title: "Expressed sequence tags from *Mesorhizobium loti* infected roots of *Lotus japonicus*" (Unpublished (1999)).

NCBI acc. No. AI973653 (gi: 5770479) (Aug. 25, 1999); Shoemaker,R., et al. "sd07h05.y1 Gm-c1020 Glycine max cDNA clone Genome Systems Clone Id: Gm-c1020-1042 5' similar to TR:O22167 O22167 EREBP ISOLOG. ;, mRNA sequence"; source: *Glycine max* (soybean).

NCBI acc. No. AI997809 (gi: 5844714) (Sep. 8, 1999); Chen,J., et al. "701670827 A. thaliana, Columbia Col-0,rosette-1 *Arabidopsis thaliana* cDNA clone 701670827, mRNA sequence"; source: *Arabidopsis thaliana* (thale cress).

NCBI acc. No. AJ238740 (gi: 8346774) (Jun. 7, 2000); Menke,F.L. H., et al. "A jasmonate- and elicitor-responsive element in the periwinkle secondary metabolite biosynthetic gene Str interacts with a jasmonate- and elicitor-inducible AP2-domain transcription factor, ORCA2" (Unpublished).

NCBI acc. No. AJ251249 (gi: 8980312) (Jul. 8, 2000); van der Fits,L., et al. "Catharanthus roseus mRNA for AP2-domain DNA-binding protein (orca3 gene)"; source: *Catharanthus roseus* (*Madagascar periwinkle*).

NCBI acc. No. AJ251250 (gi: 8980314) (Jul. 8, 2000); van der Fits,L., et al. "*Catharanthus roseus* orca3 gene for AP2-domain DNA-binding protein"; source: *Catharanthus roseus* (*Madagascar periwinkle*).

NCBI acc. No. AJ299252 (gi: 10798643) (Oct. 11, 2000); Shen,W. H., et al. "*Nicotiana tabacum* partial mRNA for AP2 domain-containing transcription factor (ap2 gene)"; source: *Nicotiana tabacum* (common tobacco).

NCBI acc. No. AJ307662 (gi: 14140112) (May 17, 2001); Mayer,K., et al. "*Oryza sativa* genomic DNA fragment, chromosome 2"; source: *Oryza sativa*.

NCBI acc. No. AL374803 (gi: 9674555) (Aug. 3, 2000); Journet,E.P., et al. "MtBB09D02F1 MtBB *Medicago truncatula* cDNA clone MtBB09D02 T3, mRNA sequence"; source: *Medicago truncatula* (barrel medic).

NCBI acc. No. AL378570 (gi: 9678322) (Aug. 3, 2000); Journet,E.P., et al. "MtBB39B01F1 MtBB *Medicago truncatula* cDNA clone MtBB39B01 T3, mRNA sequence"; source: *Medicago truncatula* (barrel medic).

NCBI acc. No. AL381730 (gi: 9681481) (Aug. 3, 2000); Journet,E.P., et al. "MtBC02F03F3 MtBC *Medicago truncatula* cDNA clone MtBC02F03 T3, mRNA sequence"; source: *Medicago truncatula* (barrel medic); Title: "*Medicago truncatula* ESTs from endomycorrhizal roots" (Unpublished (2000)).

NCBI acc. No. AL387924 (gi: 9687675) (Aug. 3, 2000); Journet,E.P., et al. "MtBC45F03F1 MtBC *Medicago truncatula* cDNA clone MtBC45F03 T3, mRNA sequence"; source: *Medicago truncatula* (barrel medic); Title: "*Medicago truncatula* ESTs from endomycorrhizal roots" (Unpublished (2000)).

NCBI acc. No. AL388234 (gi: 9687985) (Aug. 3, 2000); Journet,E.P., et al. "MtBC47D08F1 MtBC Medicago truncatula cDNA clone MtBC47D08 T3, mRNA sequence"; source: *Medicago truncatula* (barrel medic); Title: "*Medicago truncatula* ESTs from endomycorrhizal roots" (Unpublished (2000)).

NCBI acc. No. AL513404 (gi: 12711302) (Feb. 7, 2001); Salse,J., et al. "*Oryza sativa* chromosome 12 clone OSJNBa0041K23, * Sequencing in Progress *"; source: *Oryza sativa*; Title: "*Oryza sativa* chromosome 12 sequencing" (Unpublished).

NCBI acc. No. AL607006 (gi: 15799247) (Sep. 27, 2001); Han,B., et al. "*Oryza sativa* chromosome 4 clone OSJNBA0079A21, * Sequencing in Progress *"; source: *Oryza sativa*; Title: "Direct Submission" (Submitted (Jul. 28, 2000) Han Bin, National Center for Gene Research, Chinese Academy of.

NCBI acc. No. AP003237 (gi: 13027267) (Feb. 21, 2001); Sasaki,T., et al. "*Oryza sativa* chromosome 1 clone P0046E05, * Sequencing in Progress *"; source: *Oryza sativa*; Title: "*Oryza sativa* nipponbare(GA3) genomic DNA, chromosome 1, PAC clone:P0046E05" (Published Only in DataBase (2001) in press).

NCBI acc. No. AP004676 (gi: 18447935) (Jan. 30, 2002); Sasaki,T., et al. "*Oryza sativa* chromosome 2 cloneOJ1003_B06, * Sequencing in Progress *"; source: *Oryza sativa*; Title: "*Oryza sativa* nipponbare(GA3) genomic DNA, chromosome 2, BAC clone:OJ1003_B06" (Published Only in Database (2002)).

NCBI acc. No. AC000106 (gi:1785951) (Jan. 21, 1997); Osborne, B.I., et al., "*Arabidopsis thaliana* chromosome 1" (note: two versions are presented for review, gi:1785951 submitted Jan. 21, 1997; and, gi:2342673 submitted Sep. 17, 1997).

NCBI acc. No. AU057740 (gi: 4716624) (Apr. 29, 1999); Yamamoto,K., et al. "AU057740 *Oryza sativa* mature leaf Nipponbare *Oryza sativa* japonica cultivar-group) cDNA clone S21744_1A, mRNA sequence"; source: *Oryza sativa* (japonica cultivar-group); Title: "Rice cDNA from mature leaf" (Unpublished (1999)).

NCBI acc. No. AU083387 (gi: 7273843) (Mar. 21, 2000); Sasaki,T., et al. "AU083387 Rice callus *Oryza sativa* (japonica cultivar-group) cDNA clone C52828, mRNA sequence"; source: *Oryza sativa* (japonica cultivar-group); Title: "Rice cDNA from callus (2000)" (Unpublished (2000)).

NCBI acc. No. AU083389 (gi: 7273845) (Mar. 21, 2000); Sasaki,T., et al. "AU083389 Rice callus *Oryza sativa* (japonica cultivar-group) cDNA clone C52843, mRNA sequence"; source: *Oryza sativa* (japonica cultivar-group); Title: "Rice cDNA from callus (2000)" (Unpublished (2000)).

NCBI acc. No. AU083516 (gi: 7273972) (Mar. 21, 2000); Sasaki,T., et al. "AU083516 Rice mature leaf *Oryza sativa* (japonica cultivar-group) cDNA clone S21744, mRNA sequence"; source: *Oryza sativa* (japonica cultivar-group); Title: "Rice cDNA from mature leaf (2000)" (Unpublished (2000)).

NCBI acc. No. AV422393 (gi: 7777209) (May 12, 2000); Asamizu,E., et al. Title: "Generation of 7137 non-redundant expressed sequence tags from a legume, *Lotus japonicus*" (DNA Res. 7 (2), 127-130 (2000)).

NCBI acc. No. AV422968 (gi: 7778405) (May 12, 2000); Asamizu,E., et al. Title: "Generation of 7137 non-redundant expressed sequence tags from a legume, *Lotus japonicus*" (DNA Res. 7 (2), 127-130 (2000)).

NCBI acc. No. AV423260 (gi: 7778996) (May 12 2000); Asamizu,E., et al. Title: "Generation of 7137 non-redundant expressed sequence tags from a legume, *Lotus japonicus*" (DNA Res. 7 (2), 127-130 (2000)).

NCBI acc. No. AV425560 (gi: 7783624) (May 12 2000); Asamizu,E., et al. Title: "Generation of 7137 non-redundant expressed sequence tags from a legume, *Lotus japonicus*" (DNA Res. 7 (2), 127-130 (2000)).

NCBI acc. No. AV552445 (gi: 8723858) (Jun. 26, 2000); Asamizu,E., et al. "A large scale analysis of cDNA in *Arabidopsis thaliana*: Generation of 12,028 non-redundant expressed sequence tags from normalized and size-selected cDNA libraries" (DNA Res. 7 (3), 175-180 (2000)).

NCBI acc. No. AW030009 (gi: 5888765) (Sep. 15, 1999); Alcala,J., et al. "EST273264 tomato callus, TAMU *Lycopersicon esculentum* cDNA clone cLEC11J16, mRNA sequence"; source: *Lycopersicon esculentum* (*Solanum lycopersicum*).

NCBI acc. No. AW030386 (gi: 5889142) (Sep. 15, 1999); Alcala,J., et al. "EST273641 tomato callus, TAMU *Lycopersicon esculentum* cDNA clone cLEC20I12, mRNA sequence"; source: *Lycopersicon esculentum* (*Solanum lycopersicum*).

NCBI acc. No. AW034216 (gi: 5892972) (Sep. 15, 1999); Alcala,J., et al. "EST277787 tomato callus, TAMU *Lycopersicon esculentum* cDNA clone cLEC32P18 similar to Pti4, mRNA sequence"; source: *Lycopersicon esculentum* (*Solanum lycopersicum*).

NCBI acc. No. AW093577 (gi: 6059172) (Oct. 18 ,1999); D'Ascenzo,M., et al. "EST286757 tomato mixed elicitor, BTI *Lycopersicon esculentum* cDNA clone cLET25E20, mRNA sequence"; source: *Lycopersicon esculentum* (*Solanum lycopersicum*).

NCBI acc. No. AW185128 (gi: 6454445) (Nov. 19, 1999); Shoemaker,R., et al. Title: "Public Soybean EST Project" (Unpublished (1999)).

NCBI acc. No. AW200919 (gi: 6481648) (Nov. 30, 1999); Shoemaker,R., et al. Title: "Public Soybean EST Project" (Unpublished (1999)).

NCBI acc. No. AW203601 (gi: 6502228) (Dec. 1, 1999); Shoemaker,R., et al. "sf36b02.y1 Gm-c1028 *Glycine max* cDNA clone Genome Systems Clone Id: Gm-c1028-2020 5' similar to TR:O23113 O23113 AP2 Domain Containing Protein RAP2.12 ;, mRNA sequence"; source: *Glycine max* (soybean).

NCBI acc. No. AW219198 (gi: 6530072) (Dec. 6, 1999); van der Hoeven,R.S., et al. "EST301680 tomato root during/after fruit set, Cornell University *Lycopersicon esculentum* cDNA clone cLEX3G6, mRNA sequence"; source: *Lycopersicon esculentum* (*Solanum lycopersicum*).

NCBI acc. No. AW220395 (gi: 6531269) (Dec. 6, 1999); van der Hoeven,R.S., et al. "EST302878 tomato root during/after fruit set, Cornell University *Lycopersicon esculentum* cDNA clone cLEX10F20, mRNA sequence"; source: *Lycopersicon esculentum* (*Solanum lycopersicum*).

NCBI acc. No. AW221854 (gi: 6533538) (Dec. 7, 1999); Alcala,J., et al. "EST298665 tomato fruit red ripe, TAMU *Lycopersicon esculentum* cDNA clone cLEN4I21, mRNA sequence"; source: *Lycopersicon esculentum* (*Solanum lycopersicum*); Title: "Generation of ESTs from tomato fruit tissue" (Unpublished (1999)).

NCBI acc. No. AW233956 (gi: 6566281) (Dec. 13, 1999); Shoemaker,R., et al. Title: "Public Soybean EST Project" (Unpublished (1999)).

NCBI acc. No. AW267820 (gi: 6654776) (Jan. 3, 2000); Fedorova,M., et al. Title: "ESTs from roots of *Medicago truncatula* after inoculation with *Phytophthora medicaginis*" (Unpublished (1999)).

NCBI acc. No. AW267914 (gi: 6654934) (Jan. 3, 2000); Fedorova,M., et al. Title: "ESTs from roots of *Medicago truncatula* after inoculation with *Phytophthora medicaginis*" (Unpublished (1999)).

NCBI acc. No. AW278190 (gi: 6666731) (Jan. 4, 2000); Shoemaker,R., et al. Title: "Public Soybean EST Project" (Unpublished (1999)).

NCBI acc. No. AW308784 (gi: 6724385) (Jan. 21, 2000); Shoemaker,R., et al. Title: "Public Soybean EST Project" (Unpublished (1999)).

NCBI acc. No. AW329209 (gi: 7675608) (Jan. 28, 2000); Harrison,M.J., et al. Title: "ESTs from phosphate starved roots" (Unpublished (1999)).

NCBI acc. No. AW348322 (gi: 6846032) (Feb. 1, 2000); Vodkin,L, et al. "GM210001B23F6 Gm-r1021 *Glycine max* cDNA clone Gm-r1021-276 3, mRNA sequence"; source: *Glycine max* (soybean); Title: "A FunctionalGenomics Program for Soybean (NSF 9872565)" (Unpublished (1999)).

NCBI acc. No. AW349516 (gi: 6847226) (Feb. 1, 2000); Vodkin,L, et al. Title: "A Functional Genomics Program for Soybean (NSF 9872565)" (Unpublished (1999)).

NCBI acc. No. AW349638 (gi: 6847348) (Feb. 1, 2000); Vodkin,L, et al. "GM210005B21A4 Gm-r1021 *Glycine max* cDNA clone Gm-r1021-1568 3', mRNA sequence"; source: *Glycine max* (soybean).

NCBI acc. No. AW396250 (gi: 6914720) (Feb. 7, 2000); Shoemaker,R., et al. Title: "Public Soybean EST Project" (Unpublished (1999)).

NCBI acc. No. AW441715 (gi: 6976966) (Feb. 14, 2000); Alcala,J., et al. Title: "Generation of ESTs from tomato fruit tissue" (Unpublished (1999)).

NCBI acc. No. AW443265 (gi: 6985447) (Feb. 17, 2000); D'Ascenzo,M., et al. Title: "Generation of ESTs from tomato callus (mixed elicitor)" (Unpublished (1999)).

NCBI acc. No. AW507898 (gi: 7145976) (Mar. 3, 2000); Shoemaker,R., et al. Title: "Public Soybean EST Project" (Unpublished (1999)).

NCBI acc. No. AW507860 (gi: 7145938) (Mar. 3, 2000); Shoemaker,R., et al. Title: "Public Soybean EST Project" (Unpublished (1999)).

NCBI acc. No. AW559315 (gi: 7204741) (Mar. 7, 2000); Fedorova,M., et al. "EST306358 DSIR *Medicago truncatula* cDNA clone pDSIR-2515, mRNA sequence"; source: *Medicago truncatula* (barrel medic); Title: "ESTs from roots of *Medicago truncatula* after inoculation with *Phytophthora medicaginis*" (Unpublished (1999)).

NCBI acc. No. AW559329 (gi: 7204755) (Mar. 7, 2000); Fedorova,M., et al. "EST306372 DSIR *Medicago truncatula*cDNA clone pDSIR-25K15, mRNA sequence"; source: *Medicago truncatula* (barrel medic); Title: "ESTs from roots of *Medicago truncatula* after inoculation with *Phytophthora medicaginis*" (Unpublished (1999)).

NCBI acc. No. AW559374 (gi: 7204800) (Mar. 7, 2000); Fedorova,M., et al. "EST314422 DSIR *Medicago truncatula* cDNA clone pDSIR-7J9, mRNA sequence"; source: *Medicago truncatula* (barrel medic); Title: "ESTs from roots of *Medicago truncatula* after inoculation with *Phytophthora medicaginis*" (Unpublished (1999)).

NCBI acc. No. AW560196 (gi: 7205622) (Mar. 7, 2000); Fedorova,M., et al. "EST315244 DSIR *Medicago truncatula* cDNA clone pDSIR-26K12, mRNA sequence"; source: *Medicago truncatula* (barrel medic); Title: "ESTs from roots of *Medicago truncatula* after inoculation with *Phytophthora medicaginis*" (Unpublished (1999)).

NCBI acc. No. AW560968 (gi: 7206394) (Mar. 7, 2000); Fedorova,M., et al. "EST316016 DSIR *Medicago truncatula* cDNA clone pDSIR-30N21, mRNA sequence"; source: *Medicago truncatula* (barrel medic); Title: "ESTs from roots of *Medicago truncatula* after inoculation with *Phytophthora medicaginis*" (Unpublished (1999)).

NCBI acc. No. AW574222 (gi: 7238955) (Mar. 13, 2000); Fedorova,M., et al. "EST316813 GVN *Medicago truncatula* cDNA clone pGVN-52B10, mRNA sequence"; source: *Medicago truncatula* (barrel medic); Title: "ESTs from one month old nitrogen-fixing root nodules of *Medicago truncatula*" (Unpublished (2000)).

NCBI acc. No. AW596384 (gi: 7283781) (Mar. 22, 2000); Shoemaker,R., et al. "sj02f12.y1 Gm-c1032 *Glycine max* cDNA clone Genome Systems Clone Id: Gm-c1032-744 5' similar to Tr:Q40478 Q40478 EREBP-4. ;,mRNA sequence"; source: *Glycine max* (soybean); Title: "Public Soybean EST Project" (Unpublished (1999)).

NCBI acc. No. AW618245 (gi: 7324479) (Mar. 24, 2000); Alcala,J., et al. Title: "Generation of ESTs from wild tomato (*Lycopersicon pennellii*) trichomes" (Unpublished (1999)).

NCBI acc. No. AW618246 (gi: 7324480) (Mar. 24, 2000); Alcala,J., et al. Title: "Generation of ESTs from wild tomato (*Lycopersicon pennellii*) trichomes" (Unpublished (1999)).

NCBI acc. No. AW620490 (gi: 7326692) (Mar. 24, 2000); Shoemaker,R., et al. Title: "Public Soybean EST Project" (Unpublished (1999)).

NCBI acc. No. AW685799 (gi: 7560535) (Apr. 14, 2000); Watson,B. S., et al. Title: "Expressed Sequence Tags from the Samuel Roberts Noble Foundation *Medicago truncatula* nodulated root library" (Unpublished (2000)).

NCBI acc. No. AW686013 (gi: 11930899) (Apr. 14, 2000); Watson,B.S., et al. Title: "Expressed Sequence Tags from the Samuel Roberts Noble Foundation *Medicago truncatula* nodulated root library" (Unpublished (2000)).

NCBI acc. No. AW759181 (gi: 7691047) (May 4, 2000); Shoemaker,R., et al. Title: "Public Soybean EST Project" (Unpublished (1999)).

NCBI acc. No. AW760204 (gi: 7692089) (May 4, 2000); Shoemaker,R., et al. Title: "Public Soybean EST Project" (Unpublished (1999)).

NCBI acc. No. AW774176 (gi: 7718021) (May 8, 2000); VandenBosch,K., et al. Title: "ESTs from roots of *Medicago truncatula* after *Rhizobium* inoculation" (Unpublished (1999)).

NCBI acc. No. AW775590 (gi: 7765403) (May 9, 2000); Fedorova,M., et al. "EST334655 DSIL *Medicago truncatula* cDNA clone pDSIL-2C16, mRNA sequence"; source: *Medicago truncatula* (barrel medic); Title: "ESTs from leaves of *Medicago truncatula* after inoculation with *Colletotrichum trifolii*" (Unpublished (2000)).

NCBI acc. No. AW776668 (gi: 7766481) (May 9, 2000); Fedorova,M., et al. "EST335733 DSIL *Medicago truncatula* cDNA clone pDSIL-13B14, mRNA sequence"; source: *Medicago truncatula* (barrel medic); Title: "ESTs from leaves of *Medicago truncatula* after inoculation with *Colletotrichum trifolii*" (Unpublished (2000)).

NCBI acc. No. AW776671 (gi: 7766484) (May 9, 2000); Fedorova,M., et al. "EST335736 DSIL *Medicago truncatula* cDNA clone pDSIL-13B22, mRNA sequence"; source: *Medicago truncatula* (barrel medic); Title: "ESTs from leaves of *Medicago truncatula* after inoculation with *Colletotrichum trifolii*" (Unpublished (2000)).

NCBI acc. No. AW781602 (gi: 7796205) (May 12, 2000); Shoemaker,R., et al. Title: "Public Soybean EST Project" (Unpublished (1999)).

NCBI acc. No. AW782252 (gi: 7796858) (May 12, 2000); Shoemaker,R., et al. "sm03d11.y1 Gm-c1027 *Glycine max* cDNA clone Genome Systems Clone Id: Gm-c1027-7822 5' similar to TR:P93007 P93007 Cadmium-Induced Protein Isolog. ;, mRNA sequence"; source: *Glycine max* (soybean).

NCBI acc. No. AW840611 (gi: 7934594) (May 18, 2000); Anderson,J.V., et al. Title: "Identification of mRNAs expressed in underground adventitious buds of *Euphorbia esula* (leafy spurge)" (Unpublished (2000)).

NCBI acc. No. AW980481 (gi: 8172016) (Jun. 2, 2000); Fedorova,M., et al. "EST391634 GVN *Medicago truncatula* cDNA clone pGVN-30P6, mRNA sequence"; source: *Medicago truncatula* (barrel medic); Title: "ESTs from one month old nitrogen-fixing root nodules of *Medicago truncatula*" (Unpublished (2000)).

NCBI acc. No. AW980654 (gi: 8172193) (Jun. 2, 2000); Fedorova,M., et al. "EST391807 GVN *Medicago truncatula* cDNA clone pGVN-55D7, mRNA sequence"; source: *Medicago truncatula* (barrel medic); Title: "ESTs from one month old nitrogen-fixing root nodules of *Medicago truncatula*" (Unpublished (2000)).

NCBI acc. No. AW981151 (gi: 8172743) (Jun. 2, 2000); Fedorova,M., et al. "EST392345 DSIL *Medicago truncatula* cDNA clone pDSIL-12I11, mRNA sequence"; source: *Medicago truncatula* (barrel medic); Title: "ESTs from leaves of *Medicago truncatula* after inoculation with *Colletotrichum trifolii*" (Unpublished (2000)).

NCBI acc. No. AW981228 (gi: 8172715) (Jun. 2, 2000); Fedorova,M., et al. "EST392318 DSIL *Medicago truncatula* cDNA clone pDSIL-12C23, mRNA sequence"; source: *Medicago truncatula* (barrel medic); Title: "ESTs from leaves of *Medicago truncatula* after inoculation with *Colletotrichum trifolii*" (Unpublished (2000)).

NCBI acc. No. AW981323 (gi: 8172882) (Jun. 2, 2000); Fedorova,M., et al. "EST392476 DSIL *Medicago truncatula* cDNA clone pDSIL-12B14, mRNA sequence"; source: *Medicago truncatula* (barrel medic); Title: "ESTs from leaves of *Medicago truncatula* after inoculation with *Colletotrichum trifolii*" (Unpublished (2000)).

NCBI acc. No. AX033191 (gi: 10280046) (Sep. 22, 2000); Memelink,J., et al. "Sequence 2 from Patent WO0046383"; source: *Catharanthus roseus* (Madagascar periwinkle); Title: "Method of modulating metabolite biosynthesis in recombinant cells".

NCBI acc. No. AX033192 (gi: 10280047) (Sep. 22, 2000); Memelink,J., et al. "Sequence 3 from Patent WO0046383"; source: *Catharanthus roseus* (Madagascar periwinkle); Title: "Method of modulating metabolite biosynthesis in recombinant cells".

NCBI acc. No. AY192367 (gi: 28274827) (Feb. 9, 2003); Tournier,B., et al. "*Lycopersicon esculentum* ethylene response factor 1 (ERF1) mRNA, complete cds"; source: *Lycopersicon esculentum* (tomato); Title: LeERF2 defines a novel class of ethylene response factors and confers enhanced tolerance to cold stress when . . . .

NCBI acc. No. BAA07321 (gi: 1208495) (Feb. 28, 1996); Ohme-Takagi,M., et al. "EREBP-1"; source: *Nicotiana tabacum* (common tobacco).

NCBI acc. No. BAA07322 (gi: 1208496) (Feb. 28, 1996); Ohme-Takagi,M., et al. "EREBP-3"; source: *Nicotiana tabacum* (common tobacco).

NCBI acc. No. BAA07323 (gi: 1208497) (Feb. 28, 1996); Ohme-Takagi,M., et al. "EREBP-4"; source: *Nicotiana tabacum* (common tobacco); Title: "Direct Submission" (Submitted (Sep 1, 1994).

NCBI acc. No. BAA07324 (gi: 1208498) (Feb. 28, 1996); Ohme-Takagi et al. "EREBP-2"; source: *Nicotiana tabacum* (common tobacco); Title: "Direct Submission" (Submitted (Sep. 1, 1994).

NCBI acc. No. BAA76734 (gi: 4587373) (Apr. 17, 1999); Hirata,T., et al. "ethylene responsive element binding factor [*Nicotiana tabacum*]"; source: *Nicotiana tabacum* (common tobacco); Title: "Probable ethylene responsive element binding factor".

NCBI acc. No. BAA78738 (gi: 5091503) (Jun. 17, 1999); Sasaki,T., et al. "EST AU055776(S20048) corresponds to a region of the predicted gene.; Similar to *Arabidopsis thaliana* AP2 domain containing protein RAP2.10 mRNA, partial cds.(AF003103) [*Oryza sativa*]"; source: *Oryza sativa*.

NCBI acc. No. BAA81845 (gi: 5295944) (Jun. 30, 1999); Sasaki,T., et al. "Similar to *Nicotiana tabacum* mRNA for ERF1, complete cds.(D38123) [*Oryza sativa*]"; source: *Oryza sativa*.

NCBI acc. No. BAA87068 (gi: 6478845) (Nov. 30, 1999); Ashida,Y., et al. "ethylene-responsive element binding protein1 homolog [*Matricaria chamomilla*]"; source: *Matricaria chamomilla*.

NCBI acc. No. BAA94514 (gi: 7573605) (Apr. 14, 2000); Sasaki,T., et al. "Similar to *Arabidopsis thaliana* chromosome 4, BAC clone F9D16; putative Ap2 domain protein (AL035394) [*Oryza sativa*]"; source: *Oryza sativa*; Title: "*Oryza sativa* nipponbare(GA3) genomic DNA, chromosome 1, PAC clone:P0443E05".

NCBI acc. No. BAA97122 (gi: 8809571) (Jun. 28, 2000); Kitajima et al. "ethylene-responsive element binding factor [*Nicotiana sylvestris*]"; source: *Nicotiana sylvestris* (wood tobacco); Title: "Characterization of gene expression of NsERFs, transcription factors of basic PR genes from *Nicotiana sylvestris*" (Plant Cell Physiol. 41, 817-824).

NCBI acc. No. BAA97123 (gi: 8809573) (Jun. 28, 2000); Kitajima et al. "ethylene-responsive element binding factor [*Nicotiana sylvestris*]"; source: *Nicotiana sylvestris* (wood tobacco); Title: "Characterization of gene expression of NsERFs, transcription factors of basic PR genes from *Nicotiana sylvestris*" (Plant Cell Physiol. 41, 817-824).

NCBI acc. No. BAA97124 (gi: 8809575) (Jun. 28, 2000); Kitajima et al. "ethylene-responsive element binding factor [*Nicotiana sylvestris*]"; source: *Nicotiana sylvestris* (wood tobacco); Title: "Characterization of gene expression of NsERFs, transcription factors of basic PR genes from *Nicotiana sylvestris*" (Plant Cell Physiol. 41, 817-824).

NCBI acc. No. BAB03248 (gi: 9309342) (Jul. 20, 2000); Ohta,M., et al. "ethylene responsive element binding factor3 [*Oryza sativa*]"; source: *Oryza sativa*; Title: "Novel transcriptional repression in plants" (Unpublished (2000)).

NCBI acc. No. BAB07908 (gi: 9711804) (Aug. 6, 2000); Sasaki,T., et al. "hypothetical protein [*Oryza sativa*]"; source: *Oryza sativa*; Title: "*Oryza sativa* nipponbare(GA3) genomic DNA, chromosome 1, PAC clone:P0417G05" (Published Only in DataBase (2000) in press).

NCBI acc. No. BAB16083 (gi: 10567106) (Oct. 3, 2000); Ohta,M., et al. "osERF3 [*Oryza sativa*]"; source: *Oryza sativa*; Title: "A nobel repression domain of class II ERF transcriptional repressors" (Unpublished (2000)).

NCBI acc. No. BAB63735 (gi: 15290041) (Aug. 24, 2001); Sasaki,T., et al. "hypothetical protein [*Oryza sativa*]"; source: *Oryza sativa*; Title: "*Oryza sativa* nipponbare(GA3) genomic DNA, chromosome 1, PAC clone: P0694A04" (Published Only in Database (2001) in press).

NCBI acc. No. BE022152 (gi: 8284584) (Jun. 6, 2000); Shoemaker,R., et al. "sm68b06.y1 Gm-c1028 *Glycine max* cDNA clone Genome Systems Clone Id: Gm-c1028-9036 5&apos similar to TR:O23105 O23105 AP2 DOMAIN Containing Protein RAP2.3. ;, mRNA sequence"; source: *Glycine max* (soybean).

NCBI acc. No. BE024062 (gi: 8286503) (Jun. 6, 2000); Shoemaker,R., et al. "sm96c01.y1 Gm-c1015 *Glycine max* cDNA clone Genome Systems Clone Id: Gm-c1015-7897 5' similar to TR:O23105 O23105 AP2 Domain Containing Protein RAP2.3. ;, mRNA sequence"; source: *Glycine max* (soybean).

NCBI acc. No. BE203165 (gi: 8746436) (Jun. 27, 2000); VandenBosch,K., et al. "EST403187 KV1 *Medicago truncatula* cDNA clone pKV1-4L15, mRNA sequence"; source: *Medicago truncatula* (barrel medic); Title: "ESTs from roots of *Medicago truncatula* 24 hours after inoculation with *Sinorhizobium meliloti*" (Unpublished (1999)).

NCBI acc. No. BE203296 (gi: 8746567) (Jun. 27, 2000); VandenBosch,K., et al. "EST403318 KV1 *Medicago truncatula* cDNA clone pKV1-5G15, mRNA sequence"; source: *Medicago truncatula* (barrel medic); Title: "ESTs from roots of *Medicago truncatula* 24 hours after inoculation with *Sinorhizobium meliloti* " (Unpublished (1999)).

NCBI acc. No. BE318516 (gi: 11960607) (Jul. 14, 2000); Torres-Jerez,I., et al. "NF071G07LF1F1053 Developing leaf *Medicago truncatula* cDNA clone NF071G07LF 5', mRNA sequence"; source: *Medicago truncatula* (barrel medic).

NCBI acc. No. BE325359 (gi: 11935917) (Jul. 14, 2000); He,X.-Z., et al. "NF087B10ST1F1077 Developing stem *Medicago truncatula* cDNA clone NF087B10ST 5', mRNA sequence"; source: *Medicago truncatula* (barrel medic).

NCBI acc. No. BE326131 (gi: 11934119) (Jul. 14, 2000); He,X.-Z., et al. "NF085C08ST1F1055 Developing stem *Medicago truncatula* cDNA clone NF085C08ST 5', mRNA sequence"; source: *Medicago truncatula* (barrel medic).

NCBI acc. No. BE414448 (gi: 9412294) (Jul. 24, 2000); Anderson,O. A., et al. "International Triticeae EST Cooperative (ITEC): Production of Expressed Sequence Tags for Species of the Triticeae" (Unpublished (2000)).

NCBI acc. No. BE419451 (gi: 9417297) (Jul. 24, 2000); Anderson,O. A., et al. "WWS012.C2R000101 ITEC WWS Wheat Scutellum Library *Triticum aestivum* cDNA clone WWS012.C2, mRNA sequence"; source: *Triticum aestivum* (bread wheat).

NCBI acc. No. BE419533 (gi: 9417379) (Jul. 24, 2000); Anderson,O. A., et al. "WWS014.C1 R000101 ITEC WWS Wheat Scutellum Library *Triticum aestivum* cDNA clone WWS014.C1, mRNA sequence"; source: *Triticum aestivum* (bread wheat).

NCBI acc. No. BE421461 (gi: 9419304) (Jul. 24, 2000); Anderson,O. A., et al. "HWM009.E10 ITEC HWM Barley Leaf Library *Hordeum vulgare* subsp. vulgare cDNA clone HWM009.E10, mRNA sequence"; source: *Hordeum vulgare* subsp. vulgare.

NCBI acc. No. BE427272 (gi: 9425115) (Jul. 24, 2000); Anderson,O. A, et al. "PSR6192 ITEC PSR Wheat Pericarp/Testa Library *Triticum aestivum* cDNA clone PSR6192, mRNA sequence"; source: *Triticum aestivum* (bread wheat).

NCBI acc. No. BE427520 (gi: 9425363) (Jul. 24, 2000); Anderson,O. A., et al. "PSR7136 ITEC PSR Wheat Pericarp/Testa Library *Triticum aestivum* cDNA clone PSR7136, mRNA sequence"; source: *Triticum aestivum* (bread wheat).

NCBI acc. No. BE429439 (gi: 9427282) (Jul. 24, 2000); Anderson,O. A., et al. "TAS000.B08R990618 ITEC TAS Wheat cDNA Library Triticum aestivum cDNA clone TAS000.B08, mRNA sequence"; source: *Triticum aestivum* (bread wheat).

NCBI acc. No. BE429874 (gi: 9427717) (Jul. 24, 2000); Anderson,O. A., et al. "TAS004.F11R990617 ITEC TAS Wheat cDNA Library Triticum aestivum cDNA clone TAS004.F11, mRNA sequence"; source: *Triticum aestivum* (bread wheat).

NCBI acc. No. BE432465 (gi: 9430308) (Jul. 24, 2000); Alcala,J., et al. "EST398994 tomato breaker fruit, TIGR *Lycopersicon esculentum* cDNA clone cLEG8I18, mRNA sequence"; source: *Lycopersicon esculentum* (*Solanum lycopersicum*); Title: "Generation of ESTs from tomato fruit tissue, breaker stage" (Unpublished (2000)).

NCBI acc. No. BE433462 (gi: 9431305) (Jul. 24, 2000); Alcala,J., et al. "EST399991 tomato breaker fruit, TIGR *Lycopersicon esculentum* cDNA clone cLEG14M13, mRNA sequence"; source: *Lycopersicon esculentum* (*Solanum lycopersicum*); Title: "Generation of ESTs from tomato fruit tissue, breaker stage" (Unpublished (2000)).

NCBI acc. No. BE435827 (gi: 9433670) (Jul. 24, 2000); Alcala,J., et al. "EST406905 tomato breaker fruit, TIGR *Lycopersicon esculentum* cDNA clone cLEG29O9, mRNA sequence"; source: *Lycopersicon esculentum* (*Solanum lycopersicum*); Title: "Generation of ESTs from tomato fruit tissue, breaker stage" (Unpublished (2000)).

NCBI acc. No. BE436333 (gi: 9434176) (Jul. 24, 2000); Alcala,J., et al. "EST407411 tomato breaker fruit, TIGR *Lycopersicon esculentum* cDNA clone cLEG32E7, mRNA sequence"; source: *Lycopersicon esculentum* (*Solanum lycopersicum*); Title: "Generation of ESTs from tomato fruit tissue, breaker stage" (Unpublished (2000)).

NCBI acc. No. BE436391 (gi: 9434234) (Jul. 24, 2000); Alcala,J., et al. "EST407469 tomato breaker fruit, TIGR *Lycopersicon esculentum* cDNA clone cLEG32A16, mRNA sequence"; source: *Lycopersicon esculentum* (*Solanum lycopersicum*); Title: "Generation of ESTs from tomato fruit tissue, breaker stage" (Unpublished (2000)).

NCBI acc. No. BE436556 (gi: 9434399) (Jul. 24, 2000); Alcala,J., et al. "EST407634 tomato breaker fruit, TIGR *Lycopersicon esculentum* cDNA clone CLEG33I3, mRNA sequence"; source: *Lycopersicon esculentum* (*Solanum lycopersicum*); Title: "Generation of ESTs from tomato fruit tissue, breaker stage" (Unpublished (2000)).

NCBI acc. No. BE449351 (gi: 9454770) (Jul. 26, 2000); van der Hoeven,R.S., et al. "EST340367 L. hirsutum trichome, Cornell University *Lycopersicon hirsutum* cDNA clone cLHT28N22, mRNA sequence"; source: *Lycopersicon hirsutum* (*Solanum habrochaites*).

NCBI acc. No. BE449392 (gi: 9454895) (Jul. 26, 2000); van der Hoeven,R.S., et al. "EST356151 L. hirsutumtrichome, Cornell University *Lycopersicon hirsutum* cDNA clone cLHT31 K6, mRNA sequence"; source: *Lycopersicon hirsutum* (*Solanum habrochaites*).

NCBI acc. No. BE454507 (gi: 13189310) (Jul. 26, 2000); Wing,R., et al. Title: "Development of a genetically and physically anchored EST resource for barley genomics: Morex 5-45 DAP spike cDNA library" (Unpublished(2001)).

NCBI acc. No. BE459781 (gi: 9504083) (Jul. 27, 2000); Alcala,J., et al. "Generation of ESTs from tomato fruit tissue, immature green" (Unpublished (2000)).

NCBI acc. No. BE492864 (gi: 9659457) (Aug. 2, 2000); Anderson,O.D., et al. "The structure and function of the expressed portion of the wheat genomes—Vegetative apex cDNA library from *Triticum monococcum*" (Unpublished (2001)).

NCBI acc. No. BE522812 (gi: 9780790) (Aug. 9, 2000); White,J.A., et al. "A new set of *Arabidopsis* expressed sequence tags from developing seeds. The metabolic pathway from carbohydrates to seed oil" (Plant Physiol. 124(4), 1582-1594 (2000)).

NCBI acc. No. BE554847 (gi: 9819334) (Aug. 15, 2000); Shoemaker,R., et al."Public Soybean EST Project" (Unpublished (1999)).

NCBI acc. No. BE554898 (gi: 9819385) (Aug. 15, 2000); Shoemaker,R., et al. "Public Soybean EST Project" (Unpublished (1999)).

NCBI acc. No. BE610114 (gi: 9901146) (Aug. 24, 2000); Shoemaker,R., et al. "sp80h02.y1 Gm-c1044 *Glycine max* cDNA clone Genome Systems Clone Id: Gm-c1044-2284 5' similar to TR:Q40478 Q40478 EREBP-4. ;, mRNA sequence"; source: *Glycine max* (soybean).

NCBI acc. No. BE637157 (gi: 9920268) (Aug. 25, 2000); Anderson,O.D., et al. "WHE1806_H12_O24ZS *Secale cereale* anther cDNA library *Secale cereale* cDNA clone WHE1806_H12_O24, mRNA sequence"; source: *Secale cereale* (rye).

NCBI acc. No. BE642320 (gi: 9959995) (Sep. 1, 2000); Salmi,M.L., et al. Title: "Profile and analysis of gene expression changes during early development in germinating spores of *Ceratopteris richardii*" (Plant Physiol. 138(3), 1734-1745 (2005)).

NCBI acc. No. BE661059 (gi: 9986951) (Sep. 6, 2000); Harris,N., et al. "1263 GmaxSC *Glycine max* cDNA, mRNA sequence"; source: *Glycine max* (soybean); Title: "Gene expression in developing soybean seed coats" (Unpublished (2000)).

NCBI acc. No. BE804185 (gi: 10235238) (Sep. 20, 2000); Shoemaker,R., et al. "Public Soybean EST Project" (Unpublished (1999)).

NCBI acc. No. BE804368 (gi: 10235480) (Sep. 20, 2000); Shoemaker,R., et al. "sr78h05.y1 Gm-c1052 *Glycine max* cDNA clone Genome Systems Clone Id: Gm-d052-1906 5' similar to TR:Q40478 Q40478 EREBP-4. ;, mRNA sequence"; source: *Glycine max* (soybean).

NCBI acc. No. BE805304 (gi: 10236416) (Sep. 20, 2000); Shoemaker,R., et al. "ss40h06.y1 Gm-c1061 *Glycine max* cDNA clone Genome Systems Clone Id: Gm-c1061-1236 5' similar to TR:Q40478 Q40478 EREBP-4.;, mRNA sequence"; source: *Glycine max* (soybean).

NCBI acc. No. BE820195 (gi: 10252429) (Sep. 21, 2000); Vodkin,L., et al. "GM700006A11G12 Gm-r1070 *Glycine max* cDNA clone Gm-r1070-2231 3', mRNA sequence"; source: *Glycine max* (soybean); Title: "A Functional Genomics Program for Soybean (NSF 9872565)" (Unpublished (1999)).

NCBI acc. No. BE917882 (gi: 10420430) (Sep. 29, 2000); Cordonnier-Pratt,M.-M., et al. "OV1_7_C07.b1_A002 Ovary 1 (OV1) *Sorghum bicolor* cDNA, mRNA sequence"; source: *Sorghum bicolor* (sorghum); Title: "An EST database from Sorghum: ovaries of varying immature stages" (Unpublished (2000)).

NCBI acc. No. BE942996 (gi: 10520755) (Oct. 3, 2000); Cote,F., et al. Title: "ESTs from seedling roots of *Medicago truncatula* after treatment with beta glucan elicitor preparation from *Phytophthora sojae*" (Unpublished (2000)).

NCBI acc. No. BF006068 (gi: 10706343) (Oct. 6, 2000); Fedorova,M., et al. "EST434566 DSLC *Medicago truncatula* cDNA clone pDSLC-39F7, mRNA sequence"; source: *Medicago truncatula* (barrel medic); Title: "ESTs from *Medicago truncatula* leaves and cotyledons" (Unpublished (2000)).

NCBI acc. No. BF006539 (gi: 10706814) (Oct. 6, 2000); Fedorova,M., et al. "EST435037 DSLC *Medicago truncatula* cDNA clone pDSLC-41 L18, mRNA sequence"; source: *Medicago truncatula* (barrel medic); Title: "ESTs from *Medicago truncatula* leaves and cotyledons" (Unpublished (2000)).

NCBI acc. No. BF096818 (gi: 10902528) (Oct. 19, 2000); van der Hoeven,R.S., et al. "EST360845 tomato nutrient deficient roots *Lycopersicon esculentum* cDNA clone cLEW17I10 5' sequence, mRNA sequence"; source: *Lycopersicon esculentum* (*Solanum lycopersicum*).

NCBI acc. No. BF112878 (gi: 10942568) (Oct. 20, 2000); Alcala,J., et al. "EST440468 tomato breaker fruit *Lycopersicon esculentum* cDNA clone cLEG42N7 5' sequence, mRNA sequence"; source: *Lycopersicon esculentum* (*Solanum lycopersicum*).

NCBI acc. No. BF113172 (gi: 10942862) (Oct. 20, 2000); Alcala,J., et al. "EST440762 tomato breaker fruit *Lycopersicon esculentum* cDNA clone cLEG43D8 5' sequence, mRNA sequence"; source: *Lycopersicon esculentum* (*Solanum lycopersicum*).

NCBI acc. No. BF263411 (gi: 13260800) (Nov. 17, 2000); Wing,R., et al. "Development of a genetically and physically anchored EST resource for barley genomics: Blumeria infected incompatible (Mla13) seedling leaf cDNA library" (Unpublished (2001)).

NCBI acc. No. BF275458 (gi: 11206528) (Nov. 17, 2000); Wing,R.A., et al. Title: "An integrated analysis of the genetics, development, and evolution of the cotton fiber" (Unpublished (2000)).

NCBI acc. No. BF275652 (gi: 11206722) (Nov. 17, 2000); Wing,R.A., et al. Title: "An integrated analysis of the genetics, development, and evolution of the cotton fiber" (Unpublished (2000)).

NCBI acc. No. BF277659 (gi: 11208729) (Nov. 17, 2000); Wing,R.A., et al. Title: "An integrated analysis of the genetics, development, and evolution of the cotton fiber" (Unpublished (2000)).

NCBI acc. No. BF324075 (gi: 11273699) (Nov. 21, 2000); Shoemaker,R., et al. "su22c11.y1 Gm-c1068 *Glycine max* cDNA clone Genome Systems Clone Id: Gm-c1068-117 5' similar to TR:P93589 P93589 DNA binding Protein Homolog. ;, mRNA sequence"; source: *Glycine max* (soybean); Title: Public Soybean EST.

NCBI acc. no. BF425796 (gi: 11413785) (Nov. 28, 2000); Shoemaker,R., et al. Title: "Public Soybean EST Project" (Unpublished (1999)).

NCBI acc. No. BF518896 (gi: 11607651) (Dec. 8, 2000); Fedorova,M., et al. Title: "ESTs from leaves of *Medicago truncatula* after inoculation with *Colletotrichum trifolii*" (Unpublished (2000)).

NCBI acc. No. BF520727 (gi: 11609410) (Dec. 8, 2000); Fedorova,M., et al. Title: "ESTs from leaves of *Medicago truncatula* after inoculation with *Colletotrichum trifolii*" (Unpublished (2000)).

NCBI acc. No. BF588055 (gi: 11680379) (Dec. 12, 2000); Cordonnier-Pratt,M.-M., et al. Title: "An EST database from *Sorghum*: floral-induced meristems" (Unpublished (2000)).

NCBI acc. No. BF621655 (gi: 13083645) (Dec. 18, 2000); Wing,R., et al. Title: "Development of a genetically and physically anchored EST resource for barley genomics: Morex cold-stressed seedling shoot cDNA library" (Unpublished (2001)).

NCBI acc. No. BF634482 (gi: 11898640) (Dec. 19, 2000); Torrez-Jerez,I., et al. Title: "Expressed Sequence Tags from the Samuel Roberts Noble Foundation *Medicago truncatula* drought library" (Unpublished (2000)).

NCBI acc. No. BF637755 (gi: 11901913) (Dec. 19, 2000); Liu,J., et al. Title: "Expressed Sequence Tags from the Samuel Roberts Noble Foundation *Medicago truncatula* phosphate-starved leaf library" (Unpublished (2000)).

NCBI acc. No. BF644995 (gi: 11910124) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF646324 (gi: 11911454) (Dec. 20, 2000); Torres-Jerez, I., et al. Title: "Expressed Sequence Tags from the Samuel Roberts Noble Foundation—Center for Medicago Genomics Research" (Unpublished (2000)).

NCBI acc. No. BF647222 (gi: 11912352) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF647376 (gi: 11912506) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF647437 (gi: 11912567) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF648429 (gi: 11913559) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF649047 (gi: 11914093) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF649790 (gi: 11914920) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF649879 (gi: 11915009) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF650178 (gi: 11915308) (Dec. 20, 2000); Torres-Jerez,I., et al. Title: "Expressed Sequence Tags from the Samuel Roberts Noble Foundation—Center for Medicago Genomics Research" (Unpublished (2000)).

NCBI acc. No. BF650547 (gi: 11915677) (Dec. 20, 2000); Torres-Jerez, I ., et al. Title: "Expressed Sequence Tags from the Samuel Roberts Noble Foundation—Center for Medicago Genomics Research" (Unpublished (2000)).

NCBI acc. No. BF715904 (gi: 12015176) (Jan. 2, 2001); Shoemaker,R., et al. Title: "Public Soybean EST Project" (Unpublished (1999)).

NCBI acc. No. BG046680 (gi: 12495682) (Jan. 25, 2001); Shoemaker,R., et al. Title: "Public Soybean EST Project" (Unpublished (1999)).

NCBI acc. No. BG128566 (gi: 12628754) (Jan. 31, 2001); van der Hoeven,R., et al. Title: "Generation of ESTs from tomato shoot/meristem tissue" (Unpublished (2001)).

NCBI acc. No. BG129573 (gi: 12629761) (Jan. 31, 2001); van der Hoeven,R., et al. Title: "Generation of ESTs from tomato shoot/meristem tissue" (Unpublished (2001)).

NCBI acc. No. BG155935 (gi: 12689599) (Feb. 6, 2001); Shoemaker,R., et al. Title: "Public Soybean EST Project" (Unpublished (1999)).

NCBI acc. No. BG239157 (gi: 12774230) (Feb. 13, 2001); Shoemaker,R., et al. Title: "Public Soybean EST Project" (Unpublished (1999)).

NCBI acc. No. BG240408 (gi: 12775495) (Feb. 13, 2001); Cordonnier-Pratt,M.-M., et al. Title: "An Est database from *Sorghum*: ovaries of varying immature stages" (Unpublished (2000)).

NCBI acc. No. BG309153 (gi: 13110000) (Feb. 22, 2001); Wing,R., et al. Title: "Development of a genetically and physically anchored EST resource for barley genomics: *Morex* unstressed seedling shoot cDNA library" (Unpublished (2001)).

NCBI acc. No. BG309155 (gi: 13110002) (Feb. 22, 2001); Wing,R., et al. Title: "Development of a genetically and physically anchored EST resource for barley genomics: *Morex* unstressed seedling shoot cDNA library" (Unpublished (2001)).

NCBI acc. No. BG321358 (gi: 13151036) (Feb. 27, 2001); Singh,J. A., et al. Title: "Expressed Sequence Tags from Cold-Stressed *Descurainia sophia* Seedlings" (Unpublished (2001)).

NCBI acc. No. BG343807 (gi: 13156136) (Feb. 27, 2001); Wing,R., et al. Title: "Development of a genetically and physically anchored EST resource for barley genomics: *Morex* pre-anthesis spike cDNA library" (Unpublished(2001)).

NCBI acc. No. BG381764 (gi: 13306236) (Mar. 12, 2001); Anderson,J.V., et al. Title: "Identification of mRNAs expressed in underground adventitious buds of *Euphorbia esula* (leafy spurge)" (Unpublished (2000)).

NCBI acc. No. BG405293 (gi: 13311642) (Mar. 13, 2001); Shoemaker,R., et al. Title: "Public Soybean EST Project" (Unpublished (1999)).

NCBI acc. No. BG406120 (gi: 13312469) (Mar. 13, 2001); Shoemaker,R., et al. Title: "Public Soybean EST Project" (Unpublished (1999)).

NCBI acc. No. BG444654 (gi: 13354306) (Mar. 15, 2001); Wing,R. A., et al. Title: "An integrated analysis of the genetics, development, and evolution of the cotton fiber" (Unpublished (2000)).

NCBI acc. No. BG449954 (gi: 13368736) (Mar. 16, 2001); Torrez-Jerez,I., et al. Title: "Expressed Sequence Tags from the Samuel Roberts Noble Foundation *Medicago truncatula* drought library" (Unpublished (2000)).

NCBI acc. No. BG450588 (gi: 13369358) (Mar. 16, 2001); Torrez-Jerez,I., et al. Title: "Expressed Sequence Tags from the Samuel Roberts Noble Foundation *Medicago truncatula* drought library" (Unpublished (2000)).

NCBI acc. No. BG451892 (Gi: 13370674) (Mar. 16, 2001); Torrez-Jerez,I., et al. Title: "Expressed Sequence Tags from the Samuel Roberts Noble Foundation *Medicago truncatula* drought library" (Unpublished (2000)).

NCBI acc. No. BG455325 (gi: 13378650) (Mar. 19, 2001); Liu,J., et al. Title: "Expressed Sequence Tags from the Samuel Roberts Noble Foundation *Medicago truncatula* phosphate-starved leaf library" (Unpublished (2000)).

NCBI acc. No. BG459073 (gi: 13382398) Mar. 19, 2001); Anderson,J.V., et al. Title: "Identification from mRNAs expressed in underground adventitious buds of *Euphorbia esula* (leafy spurge)" (Unpublished (2000)).

NCBI acc. No. BG508757 (gi: 13479414) (Mar. 28, 2001); Shoemaker,R., et al. Title: "Public Soybean EST Project" (Unpublished (1999)).

NCBI acc. No. BG510218 (gi: 13480875) (Mar. 28, 2001); Shoemaker,R., et al. Title: "Public Soybean EST Project" (Unpublished (1999)).

NCBI acc. No. BG581520 (gi: 13596584) (Apr. 11, 2001); Fedorova,M., et al. Title: "ESTs from one month old nitrogen-fixing root nodules of *Medicago truncatula*, 2001" (Unpublished (2001)).

NCBI acc. No. BG582281 (gi: 13597345) (Apr. 11, 2001); Fedorova,M., et al. Title: "ESTs from one month old nitrogen-fixing root nodules of *Medicago truncatula*, 2001" (Unpublished (2001)).

NCBI acc. No. BG582854 (gi: 13597918) (Apr. 11, 2001); Fedorova,M., et al. Title: "ESTs from one month old nitgrogen-fixing root nodules of *Medicago truncatula*, 2001" (Unpublished (2001)).

NCBI acc. No. BG583042 (gi: 13598098) (Apr. 11, 2001); Fedorova,M., et al. Title: "ESTs from one month old nitrogen-fixing root nodules of *Medicago truncatula*, 2001" (Unpublished (2001)).

NCBI acc. No. BG583745 (gi: 13598809) (Apr. 11, 2001); Fedorova,M., et al. Title: "ESTs from one month old nitrogen-fixing root nodules of *Medicago truncatula*, 2001" (Unpublished (2001)).

NCBI acc. No. BG583761 (gi: 13598825) (Apr. 11, 2001); Fedorova,M., et al. Title: "ESTs from one month old nitrogen-fixing root nodules of *Medicago truncatula*, 2001" (Unpublished (2001)).

NCBI acc. No. BG591632 (gi: 13609772) (Apr. 12, 2001); Zhang,P., et al. Title: "Generation of ESTs from Potato Leaves Challenged with *Phytophthora infestans*, Incompatible Reaction" (Unpublished (2000)).

NCBI acc. No. BG592132 (gi: 13610272) (Apr. 12, 2001); Zhang,P., et al. Title: "Generation of ESTs from Potato Leaves Challenged with *Phytophthora infestans*, Incompatible Reaction" (Unpublished (2000)).

NCBI acc. No. BG596765 (gi: 13614905) (Apr. 12, 2001); van der Hoeven,R., et al. Title: "Generations of ESTs from sprouting potato eyes" (Unpublished (2000)).

NCBI acc. No. BG607048 (gi: 13657031) (Apr. 17, 2001); Anderson,O.D., et al. Title: "The structure and function of the expressed portion of the wheat genomes—Early reproductive apex cDNA library from *Triticum monococcum*" (Unpublished (2001)).

NCBI acc. No. BG643340 (gi: 13778565) (Apr. 24, 2001); van der Hoeven,R., et al. Title: "Generation of ESTs from tomato shoot/meristem tissue" (Unpublished (2001)).

NCBI acc. No. BG646774 (gi: 13781886) (Apr. 24, 2001); Hahn,M. G., et al. Title: "ESTs from roots of *Medicago truncatula* treated with oligogalacturonides of DP 6-20" (Unpublished (2001)).
NCBI acc. No. BG647771 (gi: 13782883) (Apr. 24, 2001); Hahn,M. G., et al. Title: "ESTs from roots of *Medicago truncatula* treated with oligogalacturonides of DP 6-20" (Unpublished (2001)).
NCBI acc. No. BG647799 (gi: 13782911) (Apr. 24, 2001); Hahn,M. G., et al. Title: "ESTs from roots of *Medicago truncatula* treated with oligogalacturonides of DP 6-20" (Unpublished (2001)).
NCBI acc. No. BG647917 (gi: 13783029) (Apr. 24, 2001); Hahn,M. G., et al. Title: "ESTs from roots of *Medicago truncatula* treated with oligogalacturonides of DP 6-20" (Unpublished (2001)).
NCBI acc. No. BG650102 (gi: 13787510) (Apr. 25, 2001); Shoemaker,R., et al. Title: "Public Soybean EST Project" (Unpublished (1999)).
NCBI acc. No. BG726262 (gi: 14011340) (May 9, 2001); Shoemaker,R., et al. Title: "Public Soybean EST Project" (Unpublished (1999)).
NCBI acc. No. BG790094 (gi: 14125656) (May 16, 2001); Shoemaker,R., et al. Title: "Public Soybean EST Project" (Unpublished (1999)).
NCBI acc. No. BG840869 (gi: 14207191) (May 25, 2001); Qiu,F., et al. Title: "Expressed Sequence Tags from B73 Maize Seedlings and Silks" (Unpublished (2001)).
NCBI acc. No. BG841174 (gi: 14207496) (May 25, 2001); Qiu,F., et al. Title: "Expressed Sequence Tags from B73 Maize Seedlings and Silks" (Unpublished (2001)).
NCBI acc. No. BG886550 (gi: 14263636) (May 30, 2001); van der Hoeven,R., et al. Title: "Generations of ESTs from dormant potato tubers" (Unpublished (2001)).
NCBI acc. No. BH454277 (gi: 17639988) (Dec. 12, 2001); Ayele,M., et al. Title: "Whole genome shotgun sequencing of *Brassica oleracea* and its application to gene discovery and annotation in *Arabidopsis*" (Genome Res. 15 (4), 487-495 (2005)).
NCBI acc. No. BH594074 (gi: 17846526) (Dec. 15, 2001); Ayele,M., et al. Title: "Whole genome shotgun sequencing of *Brassica oleracea* and its application to gene discovery and annotation in *Arabidopsis*" (Genome Res. 15 (4), 487-495 (2005)).
NCBI acc. No. BI265685 (gi: 14869141) (Jul. 18, 2001); Korth,K., et al. Title: "Expressed Sequence Tags from the Samuel Roberts Noble Foundation *Medicago truncatula* insect herbivory library" (Unpublished (2000)).
NCBI acc. No. BI271853 (gi: 14880681) (Jul. 18, 2001); Torres-Jerez,I., et al. Title: "Expressed Sequence Tags from the Samuel Roberts Noble Foundation *Medicago truncatula* flower library" (Unpublished (2001)).
NCBI acc. No. BI308635 (gi: 14982962) (Jul. 20, 2001); Grusak,M. A., et al. Title: "ESTs from developing reproductive tissues of *Medicago truncatula*" (Unpublished (2001)).
NCBI acc. No. BI308895 (gi: 14983222) (Jul. 20, 2001); Grusak,M. A., et al. Title: "ESTs from developing reproductive tissues of *Medicago truncatula*" (Unpublished (2001)).
NCBI acc. No. BI309617 (gi: 14983944) (Jul. 20, 2001); Grusak,M. A., et al. Title: "ESTs from developing reproductive tissues of *Medicago truncatula*" (Unpublished (2001)).
NCBI acc. No. BI310543 (gi: 14984870) (Jul. 20, 2001); Grusak,M. A., et al. Title: "ESTs from developing reproductive tissues of *Medicago truncatula*" (Unpublished (2001)).
NCBI acc. No. BI321594 (gi: 15000780) (Jul. 23, 2001); Shoemaker,R., et al. Title: "Public Soybean EST Project" (Unpublished (1999)).
NCBI acc. No. BI322080 (gi: 15001266) (Jul. 23, 2001); Shoemaker,R., et al. Title: "Public Soybean EST Project" (Unpublished (1999)).
NCBI acc. No. BI406379 (gi: 15185777) (Aug. 14, 2001); Crookshanks,M., et al. Title: "The potato tuber transcriptome: analysis of 6077 expressed sequence tags" (FEBS Lett. 506 (2), 123-126 (2001)).
NCBI acc. No. BI418371 (gi: 15189394) (Aug. 15, 2001); Colebatch,G., et al. Title: "*Lotus japonicus* root nodule ESTs: tools for functional genomics" (Unpublished (2000)).
NCBI acc. No. BI418604 (gi: 15189627) (Aug. 15, 2001); Colebatch,G., et al. Title: "*Lotus japonicus* root nodule ESTs: tools for functional genomics" (Unpublished (2000)).
NCBI acc. No. BI420305 (gi: 15191328) (Aug. 15, 2001); Colebatch,G., et al. Title: "*Lotus japonicus* root nodule ESTs: tools for functional genomics" (Unpublished (2000)).
NCBI acc. No. BI421270 (gi: 15194638) (Aug. 16, 2001); Alcala,J., et al. Title: "Generation of ESTs from tomato callus tissue" (Unpublished (1999)).
NCBI acc. No. BI421507 (gi: 15195085) (Aug. 16, 2001); Alcala,J., et al. Title: "Generation of ESTs from tomato callus tissue" (Unpublished (1999)).
NCBI acc. No. BI421558 (gi: 15195182) (Aug. 16, 2001); Alcala,J., et al. Title: "Generation of ESTs from tomato callus tissue" (Unpublished (1999)).
NCBI acc. No. BI421722 (gi: 15195509) (Aug. 16, 2001); Alcala,J., et al. Title: "Generation of ESTs from tomato callus tissue" (Unpublished (1999)).
NCBI acc. No. BI421895 (gi: 15195839) (Aug. 16, 2001); Alcala,J., et al. Title: "Generation of ESTs from tomato callus tissue" (Unpublished (1999)).
NCBI acc. No. BI426037 (gi: 15203269) (Aug. 16, 2001); Shoemaker,R., et al. Title: "Public Soybean EST Project" (Unpublished (1999)).
NCBI acc. No. BI427468 (gi: 15204700) (Aug. 16, 2001); Shoemaker,R., et al. Title: "Public Soybean EST Project" (Unpublished (1999)).
NCBI acc. No. BI436183 (gi: 15260873) (Aug. 21, 2001); van der Hoeven,R., et al. Title: "Generation of ESTs from in vitro grown microtubers" (Unpublished (2001)).
NCBI acc. No. BI468669 (gi: 15284778) (Aug. 24, 2001); Shoemaker,R., et al. Title: "Public Soybean EST Project" (Unpublished (1999)).
NCBI acc. No. BI469284 (gi: 15285393) (Aug. 24, 2001); Shoemaker,R., et al. Title: "Public Soybean EST Project" (Unpublished (1999)).
NCBI acc. No. BI470707 (gi: 15286816) (Aug. 24, 2001); Shoemaker,R., et al. Title: "Public Soybean EST Project" (Unpublished (1999)).
NCBI acc. No. BQ165291 (gi: 20307557) (Apr. 25, 2002); VandenBosch,K., et al. Title: "The *Medicago truncatula* 'kiloclone' set; ESTs selected and re-arrayed from various libraries" (Unpublished (2002)).
NCBI acc. No. CAB93939 (gi: 8346773) (Jun. 7, 2000); Menke,F.L. H., et al. Title: "A jasmonate- and elicitor-responsive element in the periwinkle secondary metabolite biosynthetic gene Str interacts with a jasmonate- and elicitor-inducible AP2-domain transcription factor, ORCA2" (Unpublished).
NCBI acc. No. CAB93940 (gi: 8346775) (Jun. 7, 2000); Menke,F.L. H., et al. Title: "A jasmonate- and elicitor-responsive element in the periwinkle secondary metabolite biosynthetic gene Str interacts with a jasmonate- and elicitor-inducible AP2-domain transcription factor, ORCA2" (Unpublished).
NCBI acc. No. CAB96899 (gi: 8980313) (Jul. 8, 2000); van der Fits,L., et al. Title: "ORCA3, a jasmonate-responsive master regulator of multiple genes in plant primary and secondary metabolism" (Unpublished).
NCBI acc. No. CAB96900 (gi: 8980315) (Jul. 8, 2000); van der Fits,L., et al. "AP2-domain DNA-binding protein [*Catharanthus roseus*]"; source: *Catharanthus roseus* (Madagascar periwinkle); Title: ORCA3, a jasmonate-responsive master regulator of multiple genes in plant primary and secondary.
NCBI acc. No. CAC12822 (gi: 10798644) (Oct. 11, 2000); Shen,W. H., et al. Title: "*Nicotiana tabacum* cDNA (partial) encoding AP2 domain-containing protein" (Unpublished).
NCBI acc. No. CAC21763 (gi: 12225884) (Jan. 14, 2001); Helentjaris,T.G., et al. Title: "Signal transduction genes and methods of use" (Patent: WO 0070059-A Nov. 23, 2000; Pioneer HI-Bred International, Inc. (US)).
NCBI acc. No. CAC21771 (gi: 12225916) (Jan. 14, 2001); Helentjaris,T.G., et al. Title: "Signal transduction genes and methods of use" (Patent: WO 0070059-A Nov. 23, 2000; Pioneer HI-Bred International, Inc. (US)).

NCBI acc. No. CAC39058 (gi: 14140141) (May 17, 2001); Mayer,K., et al. Title: "Conservation of microstructure bewtween a sequenced region of the genome of rice and multiple segments of the genome of *Arabidopsis thaliana*" (Unpublished).

NCBI acc. No. CAC39060 (gi: 14140143) (May 17, 2001); Mayer,K., et al. Title: "Conservation of microstructure bewtween a sequenced region of the genome of rice and multiple segments of the genome of *Arabidopsis thaliana*" (Unpublished).

NCBI acc. No. CG333070 (gi: 34250336) (Aug. 26, 2003); Whitelaw,C.A., et al. Title: "Consortium for Maize Genomics" (Unpublished (2002)).

NCBI acc. No. CK260302 (gi: 39817280) (Dec. 12, 2003); Rensink,W., et al. Title: "Analyzing the potato abiotic stress transcriptome using expressed sequence tags" (Genome 48 (4), 598-605 (2005)).

NCBI acc. No. CK277725 (gi: 39834703) (Dec. 12, 2003); Rensink,W., et al. Title: "Analyzing the potato abiotic stress transcriptome using expressed sequence tags" (Genome 48 (4), 598-605 (2005)).

NCBI acc. No. D38123 (gi: 790359) (May 1, 1995); Ohme-Takagi,M., et al. "Tobacco mRNA"; source: Unknown.; Title: "Etylene-inducible DNA binding proteins that interact with an ethylene responsive element" (The Plant Cell 7, 173-182 (1995)).

NCBI acc. No. D38125 (gi: 790361) (May 1, 1995); Ohme-Takagi,M., et al. "Tobacco mRNA"; source: Unknown.; Title: "Etylene-inducible DNA binding proteins that interact with an ethylene responsive element" (The Plant Cell 7, 173-182 (1995)).

NCBI acc. No. D38126 (gi: 790362) (May 1, 1995); Ohme-Takagi,M., et al. "Tobacco mRNA"; source: Unknown.; Title: "Etylene-inducible DNA binding proteins that interact with an ethylene responsive element" (The Plant Cell 7, 173-182 (1995)).

NCBI acc. No. N97133 (gi: 1269500) (Aug. 16, 1995); Newman,T., et al. Title: "Genes galore: a summary of methods for accessing results from large-scale partial sequencing of anonymous *Arabidopsis* cDNA clones" (Plant Physiol. 106, 1241-1255 (1994)).

NCBI acc. No. O04681 (gi: 7531180) (Apr. 10, 2000); Zhou,J., et al. Title: "The Pto kinase conferring resistance to tomato bacterial speck disease interacts with proteins that bind a cis-element of pathogenesis-related genes" (EMBO J. 16 (11), 3207-3218 (1997)).

NCBI acc. No. O04682 (gi: 7531181) (Apr. 10, 2000); Zhou,J., et al. Title: "The Pto kinase conferring resistance tomato bacterial speck disease interacts with proteins that bind a cis-element of pathogenesis-related genes" (EMBO J. 16 (11), 3207-3218 (1997)).

NCBI acc. No. T01986 (gi: 7489208) (Apr. 6, 2000); Park,J.M., et al. "Tsi1 protein—common tobacco"; source: *Nicotiana tabacum* (common tobacco); Title: "Direct Submission" (Submitted (??-Apr. 1998) to the EMBL Data Library).

NCBI acc. No. T02432 (gi: 7489123) (Apr. 6, 2000); Ohme-Takagi,M., et al. Title: "Ethylene-inducible DNA binding proteins that interact with an ethylene-responsive element" (Plant Cell 7 (2), 173-182 (1995)).

NCBI acc. No. T02433 (gi: 7489114) (Apr. 6, 2000); Ohme-Takagi,M., et al. Title: "Ethylene-inducible DNA binding proteins that interact with an ethylene-responsive element" (Plant Cell 7 (2), 173-182 (1995)).

NCBI acc. No. T02434 (gi: 7489115) (Apr. 6, 2000); Ohme-Takagi,M., et al. Title: "Ethylene-inducible DNA binding proteins that interact with an ethylene-responsive element" (Plant Cell 7 (2), 173-182 (1995)).

NCBI acc. No. T02590 (gi: 7489113) (Apr. 6, 2000); Ohme-Takagi,M., et al. Title: "Ethylene-inducible DNA binding proteins that interact with an ethylene-responsive element" (Plant Cell 7 (2), 173-182 (1995)).

NCBI acc. No. T03927 (gi: 7489116) (Apr. 6, 2000); Xu,P., et al. "DNA binding protein S25-XP1—common tobacco"; source: *Nicotiana tabacum* (common tobacco); Title: "Direct Submission" (Submitted (??-Dec. 1996) to the EMBL Data Library).

NCBI acc. No. T07686 (gi: 7489077) (Apr. 6, 2000); Zhou, J., et al. "transcription factor Pti4—tomato (fragment)"; source: *Lycopersicon esculentum* (tomato); Title: "Direct Submission" (Submitted (??-Jul. 1998) to the EMBL Data Library).

NCBI acc. No. T07689 (gi: 7489078) (Apr. 6, 2000); Zhou,J., et al. Title: "The Pto kinase conferring resistance to tomato bacterial speck disease interacts with proteins that bind a cis-element of pathogenesis-related genes" (EMBO J. 16 (11), 3207-3218 (1997)).

NCBI acc. No. T07728 (gi: 7489079) (Apr. 6, 2000); Zhou,J., et al. Title: "The Pto kinase conferring resistance to tomato bacterial speck disease interacts with proteins that bind a cis-element of pathogenesis-related genes" (EMBO J. 16 (11), 3207-3218 (1997)).

NCBI acc. No. T07784 (gi: 7489226) (Apr. 6, 2000); Leggewie,G., et al. "A cDNA from potato with homology to DnaJ is identical to a hitherto unidentified gene that is induced upon tuberization in potato and upon flowering in tobacco" (Plant Physiol. 117, 1127 (1998)).

NCBI acc. No. U81157 (gi: 1732405) (Dec. 16, 1996); Xu,P., et al. "Direct Submission" (Submitted (Dec. 6, 1996) Biotechnology Institute, Zhejiang Agriculture Unversity, Hangzhou, Zhejiang 310029, P.R.China).

NCBI acc. No. U89255 (gi: 2213780) (Jun. 25, 1997); Zhou,J., et al. "The Pto Kinase Conferring Resistance to Tomato Bacterial Speck Disease Interacts with Proteins that Bind a Cis-Element of Pathogenesis-Related Genes" (EMBO J. 16, 3207-3218 (1997)).

NCBI acc. No. U89256 (gi: 2213782) (Jun. 25, 1997); Zhou,J., et al. "The Pto Kinase Conferring Resistance to Tomato Bacterial Speck Disease Interacts with Proteins that Bind a Cis-Element of Pathogenesis-Related Genes" (EMBO J. 16, 3207-3218 (1997)).

NCBI acc. No. U91857 (gi: 4099913) (Jan. 5, 1999); Gardner,R.C., et al. "*Stylosanthes hamata* ethylene-responsive element binding protein homolog gene, complete cds"; source: *Stylosanthes hamata*; Title: "Aluminium Tolerance in Yeast Conferred by Over-expression of *Stylosanthes* genes" (Unpublished).

NCBI acc. No. U91982 (gi: 4099920) (Jan. 5, 1999); Gardner,R.C., et al. "*Stylosanthes hamata* EREBP-3 homolog mRNA, complete cds"; source: *Stylosanthes hamata*; Title: "Aluminium Tolerance in Yeast Conferred by Over-expression of *Stylosanthes* Genes" (Unpublished).

NCBI accession No. X59714 (gi:22379) (Apr. 21, 1993); Benoist, C, "*Z.mays* mRNA for CAAT-box DNA binding protein subunit B (NF-YB)"; (*Zea mays*) (note: the original submission and latest update are provided for examination) (publication: see Nucleic Acids Res. 20 (5), 1087-1091, 1992, Evolutionary variation of the CCAAT-binding transcription factor NF-Y.

NCBI accession No. Y13724 (gi:2398528) (Sep. 16, 1997); Edwards, D., "*Arabidopsis thaliana* mRNA for Hap3b transcription factor" (note: the original submission and latest update are provided for examination).

NCBI acc. No. AA598183 (gi: 2413606) (Sep. 20, 1997); Newman,T., et al. Title: "Genes galore: a summary of methods for accessing results from large-scale partial sequencing of anonymous *Arabidopsis* cDNA clones" (Plant Physiol. 106, 1241-1255 (1994)).

NCBI acc. No. T00409 (gi: 276890) (Nov. 10, 1992); McCombie,W. R., et al. Title: "*Caenorhabditis elegans* cDNAs" (Unpublished (1993)).

NCBI accession No. AF193440 (gi:6289056) (Nov. 9, 1999); Gherraby, W., et al., "*Arabidopsis thaliana* heme activated protein (HAP5c) mRNA, complete cds".

TREMBL Acc. No. AB008103 (Aug. 21, 1998); "*Arabidopsis thaliana* AtERF-1 mRNA for ethylene responsive element binding factor 1, complete cds."

NCBI acc. No. AB008104 (gi: 3434968) (Aug. 19, 1998); Usui.A., et al. Title: "ERF family" (Unpublished (1998)).

TREMBL Acc. No. AB009055 (Sep. 3, 1999); , et al. "*Arabidopsis thaliana* genomic cDNA chromosome 5, P1 clone: MXC20".

Database GenEMBL AC002338 Online, Jul. 24, 1997; Lin et al. Title: "Sequence and analysis of chromosome 2 of the plant *Arabidopsis thaliana*, Nature" (Dec. 16, 1999) vol. 402, pp. 761-768.

TREMBL Acc. No. AC002388 (Aug. 4, 1997); Rounsley S. D. et al., "*Arabidopsis thaliana* chromosome II BAC T13E15 genomic sequence, complete sequence."

TREMBL Acc. No. AF003096 (Jul. 28, 1997); "*Arabidopsis thaliana* AP2 domain containing protein RAP2.3 mRNA, complete cds."

TREMBL Acc. No. AF007269 (Jun. 24, 1997); "*Arabidopsis thaliana* BAC IG002N01."

NCBI acc. No. AI999616 (gi: 5846521) (Sep. 8, 1999); Chen,J., et al. Title: "*Arabidopsis thaliana* Gene Expression MicroArray" (Unpublished (1999)).

TREMBL Acc. No. AL161546 (Mar. 16, 2000); "*Arabidopsis thaliana* DNA chromosome 4, contig fragment No. 46".
TREMBL Acc. No. O80337 (May 30, 2000); "Ethylene-responsive transcription factor 1A (Ethylene-responsive element binding factor 1A) (EREBP-1A) (AtERF1)."
TREMBL Acc. No. P42736 (Nov. 1, 1995); "AP2 domain transcription factor RAP2.3 (Related to AP2 protein 3) (Cadmium-induced protein AS30)."
TREMBL Acc. No. U89255 (Jun. 28, 1997); "*Lycopersicon esculentum* DNA-binding protein Pti4 mRNA, complete cds." (Duplicate entry above for U89255).
TREMBL Acc. No. Z97343 (Jul. 4, 1997); "*Arabidopsis thaliana* DNA chromosome 4, ESSA I FCA contig fragment No. 8".
TREMBL Acc. No. O22167 (Q8L9K1) (Jan. 1, 1998); Rounsley, et al.
NCBI acc. No. NP_182011 (gi: 15225361) (Aug. 21, 2001); Lin,X., et al. Title: "Sequence and analysis of chromosome 2 of the plant *Arabidopsis thaliana*" (Nature 402 (6763), 761-768 (1999)).
NCBI acc. No. NP_567530 (gi: 18414897) (Jan. 29, 2002); , et al. "ethylene responsive element binding factor 1 (frameshift !)"; source: Unknown.; Title:"".
NCBI acc. No. ABD19651 (gi: 87116574) (Feb. 10, 2006); Shinn,P., et al. "At5g47220 [*Arabidopsis thaliana*]"; source: *Arabidopsis thaliana* (thale cress); Title: "*Arabidopsis* ORF clones" (Unpublished).
NCBI acc. No. Y10555 (gi: 2695702) (Dec. 18, 1997); Putterill,J.J., et al. "*A.thaliana* mRNA for CONSTANS protein"; source: *Arabidopsis thaliana* (thale cress); Title: "The flowering-time gene CONSTANS and homologue CONSTANS Like 1 exist as a tandem repeat on chromosome 5 of *Arabidopsis*" (Unpublished).
Ainley et al., Regulatable endogenous production of cytokinins up to 'toxic' levels in transgenic plants and plant tissues, The Plant Mol. Biol. (Apr. 1993) 22:13-23.
Allen, M.D., et al. (1998). A novel mode of DNA recognition by a beta-sheet revealed by the solution structure of the GCC-box binding domain in complex with DNA. Embo J 17, 5484-5496.
An et al., Organ-Specific and Developmental Regulation of the Nopaline Synthase Promoter in Transgenic Tobacco Plants. (May 1988) Plant Physiology 88:547-552.
Anand, Ajith et al: "Greenhouse and field testing of transgenic wheat plants stably expressing genes for thaumatin-like protein, chitinase and glucanase against *Fusarium graminearum*" J of Exper Botany, vol. 54, No. 384, Mar. 2003, pp. 1101-1111.
Aoyama et al. (Nov. 1995) Ectopic expression of the *Arabidopsis* transcriptional activator Athb-1 alters leaf cell fate in tobacco. Plant Cell 7:1773-1785.
Asamizu, et al. (2000) Generation of 7137 non-redundant expressed sequence tags from a legume, *Lotus japonicus*. DNA Res. 7 (2), 127-130.
Asamizu, et al. (2000) A large scale analysis of cDNA in *Arabidopsis thaliana*: Generation of 12,028 non-redundant expressed sequence tags from normalized and size-selected cDNA libraries. DNA Res. 7 (3), 175-180.
NCBI acc. No. Y10556 (gi: 2695704) (Dec. 18, 1997); Putterill.J.J., et al. "*A.thaliana* constans gene"; source: *Arabidopsis thaliana* (thale cress); Title: "The flowering-time gene CONSTANS and homologue CONSTANS Like 1 exist as a tandem repeat on chromosome 5 of *Arabidopsis*" (Unpublished).
Ashida, Y. et al. (2002). Molecular cloning and mRNA expression of geraniol-inducible genes in cultured shoot primordia of *Matricaria chamomilla*. Biosci. Biotechnol. Biochem. 66 (11), 2511-2514.
Ayele, et al. (2005). Whole genome shotgun sequencing of *Brassica oleracea* and its application to genediscovery and annotation in *Arabidopsis*. Genome Res. 15 (4), 487-495.
Baerson et al. (Dec. 1994). Identification of domains in an *Arabidopsis* acyl carrier protein gene promoter required for maximal organ-specific expression. Plant Mol. Biol. 26:1947-1959.
Baerson et al. (May 1993). Developmental regulation of an acyl carrier protein gene promoter in vegetative and reproductive tissues. Plant Mol. Biol. 22:255-267.
Baumann et al. (Mar. 1999). The DNA Binding Site of the Dof Protein NtBBF1 Is Essential for Tissue-Specific . . . , The Plant Cell 11:323-334.

Berrocal-Lobo, M., et al. (2002). Constitutive expression of Ethylene-Response-Factor1 in *Arabidopsis* confers resistance to several necrotrophic fungi. Plant J 29, 23-32.
Berrocal-Lobo, M., and Molina, A. (2004). Ethylene response factor 1 mediates *Arabidopsis* resistance to the soilborne fungus *Fusarium oxysporum*. Mol Plant Microbe Interact 17, 763-770.
Bevan, et al. (Jan. 1998) Analysis of 1.9 Mb of contiguous sequence from chromosome 4 of *Arabidopsis thaliana*. Nature 391 (6666):438-9.
Bird et al. (1988). The tomato polygalacturonase gene and ripening-specific expression in transgenic plants. Plant Mol. Biol. 11:651-662.
Bohmert et al., AG01 defines a novel locus of *Arabidopsis* controlling leaf development, EMBO J. (Jan. 2, 1998) 17:170-180.
Bork, P., Powers and Pitfalls in Sequence Analysis: The 70% Hurdle. Genome Research, vol. 10, 2000; pp. 398-400.
Bowman et al., Crabs Claw, a gene that regulates carpel and nectary developments in *Arabidopsis*, encodes a novel protein . . . , Development (Jun. 1999) 126:2387-2396.
Brown, R.L., et al. (2003). A role for the GCC-box in jasmonate-mediated activation of the PDF1.2 gene of *Arabidopsis*. Plant Physiol 132, 1020-1032.
Buerglin in Duboule (ed.) (1994) Guidebook to the Homeobox Genes, Oxford University Press, Oxford, UK pp. 27-71.
Bustin and Reeves (1996) High-mobility-group chromosomal proteins: architectural components that facilitate chromatin function. Prog. Nucl. Acids Res. Mol. Biol. 54:35-100.
Buttner et al (May 1997) "*Arabidopsis thaliana* ethylene-responsive element binding protein (AtEBP), an ethylene-inducible, GCC box DNA-binding protein interacts with an ocs element binding protein." Proc. Natl. Acad. Sci. USA 94: 5961-5966.
Campbell, et al. (1998). Isolation of a cDNA from potato with structural similarity to the AP2 gene superfamily (Accession No. U77655) (PGR98-129). Plant Physiol. 117 (3), 1127.
Cao et al. (May 1998). Generation of broad-spectrum disease resistance by overexpression of an essential regulatory gene in systemic acquired resistance. Proc. Natl. Acad. Sci. USA 95:6531-6536.
Century et al. (1997). NDR1, a Pathogen-Induced Component Required for *Arabidopsis* Disease Resistance.Science 278:1963-1965.
NCBI acc. No. CAA71587 (gi: 2695703) (Dec. 18, 1997); Putterill. J.J., et al. "CONSTANS [*Arabidopsis thaliana*]"; source: *Arabidopsis thaliana* (thale cress); Title: "The flowering-time gene CONSTANS and homologue CONSTANS Like 1 exist as a tandem repeat on chromosome 5 of *Arabidopsis*" (Unpublished).
Chakravarthy, S., et al. (2003). The tomato transcription factor Pti4 regulates defense-related gene expression via GCC box and non-GCC box cis elements. Plant Cell 15, 3033-3050.
Chao et al. (Jun. 27, 1997). Activation of the Ethylene Gas Response Pathway in *Arabidopsis* by the Nuclear Protein . . . , Cell 89:1133-1144.
Chen, C, and Chen, Z. (2002). Potentiation of developmentally regulated plant defense response by AtWRKY18, a pathogen-induced *Arabidopsis* transcription factor. Plant Physiol 129, 706-716.
Chen, W., et al. (2002). Expression profile matrix of *Arabidopsis* transcription factor genes suggests their putative functions in response to environmental stresses. Plant Cell 14, 559-574.
Chen, J. et al. (2003) An AP2/EREBP-type transcription factor gene from rice is cold-inducible and encodes a nuclear-localized protein. Theoretical and Applied Genetics 2003, vol. 107, pp. 972-979.
Cheong, Y.H., et al. (2002). Transcriptional profiling reveals novel interactions between wounding, pathogen, abiotic stress, and hormonal responses in *Arabidopsis*. Plant Physiol 129, 661-677.
Cheong, Y.H., et al. (2003). BWMK1, a rice mitogen-activated protein kinase, locates in the nucleus and mediates pathogenesis-related gene expression by activation of a transcription factor. Plant Physiol 132, 1961-1972.
Crookshanks, et al. (2001). The potato tuber transcriptome: analysis of 6077 expressed sequence tags. FEBS Lett. 506 (2), 123-126.
Da Costa E Silva et al. (Jul. 1993) BPF-1, a pathogen-induced DNA-binding protein involved in the plant defense response. Plant J. 4:125-135.
Daly et al. (Dec. 2001). Plant Systematics in the Age of Genomics. Plant Physiology 127:1328-1333.

Dehesh et al (Dec. 1990). A trans-acting factor that binds to a GT-motif in a phytochrome gene promoter. Science 250:1397-1399.

Di Laurenzio et al. (Aug. 9, 1996). The Scarecrow Gene Regulates an Asymmetric Cell Division That is Essential . . . , Cell 86:423-433.

Durrant, et al. (2000) cDNA-AFLP reveals a striking overlap in race-specific resistance and wound response gene expression profiles. Plant Cell 12 (6), 963-977.

Edwards, D., Murray, J.A., and Smith, A.G. (Jul. 1998). Multiple genes encoding the conserved CCAAT-box transcription factor complex are expressed in *Arabidopsis*. Plant Physiol 117, 1015-1022.

Elomaa, P., et al. (1996) Transformation of antisense constructs of the chalcone synthase gene superfamily into *Gerbera hybrida*: differential effect on the expression of family members. Molecular Breeding vol. 2, pp. 41 -50.

Estruch et al. (1994) Nucl. Acids Res. 22:3983-3989.

Eulgem, Thomas et al. (Sep. 1999). Early nuclear events in plant defense signalling: Rapid gene activation by WRKY transcription factors EMBO Journal, vol. 18, No. 17, pp. 4689-4699.

Feng, et al., (2002). Sequence and analysis of rice chromosome 4. Nature 420 (6913), 316-320.

Finkelstein, R.R., et al. (1998). The *Arabidopsis* abscisic acid response locus ABI4 encodes an APETALA 2 domain protein. Plant Cell 10, 1043-1054.

Fischer, U., and Droge-Laser, W. (2004). Overexpression of NtERF5, a new member of the tobacco ethylene response transcription factor family enhances resistance to tobacco mosaic virus. Mol Plant Microbe Interact 17, 1162-1171.

Forsburg, S.L. and Guarente, L.(Aug. 1989). Identification and characterization of HAP4: a third component of the CCAAT-bound HAP2/HAP3 heteromer. Genes Dev. 3:1166-1178.

Foster et al., Plant bZIP proteins gather at ACGT elements, FASEB J. (Feb. 1994) 8:192-200.

Fromm et al., An Octopine Synthase Enhancer Element Directs Tissue-Specific Expression and Binds ASF-1, a Factor from Tobacco Nuclear Extracts. (Oct. 1989) The Plant Cell 1:977-984.

Fujimoto, S.Y., et al. (2000). *Arabidopsis* ethylene-responsive element binding factors act as transcriptional activators or repressors of GCC box-mediated gene expression. Plant Cell 12, 393-404.

Gatz C, Chemical Control of Gene Expression, Annu. Rev. Plant Physiol. Plant Mol. Biol. (Jun. 1997) 48:89-108.

Gill and Ptashne (1987). Mutants of GAL4 protein altered in an activation function. Cell 51:121-126.

Giovannoni, et al. (1999) Genetic mapping of ripening and ethylene related loci in tomato. Theor. Appl. Genet. 98 (6/7), 1005-1013.

Giraudat et al. (Oct. 1992). Isolation of the *Arabidopsis* ABI3 gene by positional cloning. Plant Cell 4:1251-1261.

Gong, et al. (Jun. 2004). Genome-wide ORFeome cloning and analysis of *Arabidopsis* transcription factor genes. Plant Physiol. 135(2):773-782.

Gu, Y.Q., et al. (2000). Pti4 is induced by ethylene and salicylic acid, and its product is phosphorylated by the Pto kinase. Plant Cell 12, 771-786.

Gu, Y.Q., et al. (2002). Tomato transcription factors pti4, pti5, and pti6 activate defense responses when expressed in *Arabidopsis*. Plant Cell 14, 817-831.

Guervara-Garcia (1998). A 42 bp fragment of the pmas10 promoter containing an ocs-like element confers a developmental, wound- and chemically inducible expression pattern. Plant Mol. Biol. 38:743-753.

Guo, H., and Ecker, J.R. (2004). The ethylene signaling pathway: new insights. Curr Opin Plant Biol 7, 40-49.

Guo, Z.J., et al. (2004a). Overexpression of the AP2/EREBP transcription factor OPBP1 enhances disease resistance and salt tolerance in tobacco. Plant Mol Biol 55, 607-618.

Guo, et al. (2004) Protein tolerance to random amino acid change. Proc. Natl. Acad. Sci. USA 101: 9205-9210.

Gutterson, et al. (2004) Regulation of disease resistance pathways by AP2/ERF transcription factors. Current Opin. in Plant Biology, vol. 7, pp. 465-471.

Hall et al., Golden 2: A Novel Transcriptional Regulator of Cellular Differentiation in the Maize Leaf. The PlantCell (Jun. 1998) 10:925-936.

Hao, D., et al. (2002). Determinants in the sequence specific binding of two plant transcription factors, CBF1 and NtERF2, to the DRE and GCC motifs. Biochemistry 41, 4202-4208.

Hao, D., et al. (1998). Unique mode of GCC box recognition by the DNA-binding domain of ethylene-responsive element-binding factor (ERF domain) in plant. J Biol Chem 273, 26857-26861.

He, P., et al. (2001). Overexpression of Pti5 in tomato potentiates pathogen-induced defense gene expression and enhances disease resistance to *Pseudomonas syringae* pv. tomato. Mol Plant Microbe Interact 14, 1453-1457.

Heard et al. (Jul. 1997) Evolutionary diversity of symbiotically induced nodule MADS box genes:characterizatoin of nmhC5, a member of a novel subfamily. Molecular Plant-Microbe Interactions. Jul. 1997, vol. 10, No. 5, pp. 665-676.

Heard et al. (Jun. 1995) Symbiotic induction of a MADS-box gene during development of alfalfa root nodules. Proc. Natl. Acad. Sci. USA, vol. 92, pp. 5273-5277.

Hill, et al. (1998). Functional Analysis of Conserved Histidines in ADP-Glucose . . . Biochem. Biophys. Res. Comm. 244: 573-577.

Hollung, Kristin et al. (Jun. 1997) Developmental stress and ABA modulation of mRNA levels for bZIP transcription factors and Vp1 in barley embryos and embryo-derived suspension cultures, Plant Molecular Biology, vol. 35, No. 5, pp. 561-571.

Horvath, et al. (1998). Four classes of salicylate-induced tobacco genes. Mol. Plant Microbe Interact. 11 (9), 895-905.

Ishiguro, S. and Nakamura, K. (Sep. 28, 1994). Characterization of a cDNA encoding a novel DNA-binding protein, SPF1, that recognizes SP8 sequences in the 5' upstream regions of genes coding for sporamin and beta-amylase from sweet potato. Mol. Gen. Genet. 244: 563-571.

Jaglo-Ottosen, K.R., et al. (1998). *Arabidopsis* CBF1 overexpression induces COR genes and enhances freezing tolerance. Science 280, 104-106.

Jia, Y. and Martin, G.B. (Jun. 1999). Rapid transcript accumulation of pathogenesis-related genes during an incompatible interaction in bacterial speck disease-resistant tomato plants. Plant Molec. Biol. 40: 455-465.

Jofuku, K.D., et al. (1994). Control of *Arabidopsis* flower and seed development by the homeotic gene APETALA2. Plant Cell 6, 1211-1225.

Kaiser, T. and Batschauer A. (May 1995). Cis-acting elements of the CHS1 gene from white mustard controlling promoter activity and spatial patterns of expression. Plant Mol. Biol. 28:231-243.

Kaneko, et al. (Jun. 1999) Structural analysis of *Arabidopsis thaliana* chromosome 5. IX. Sequence features of the regions of 1,011,550 bp covered by seventeen P1 and TAC clones. DNA Res. 6(3):183-95.

Kasuga Mie et al. (Mar. 1999) "Improving plant drought, salt, and freezing tolerance by gene transfer of a single stress-inducible transcription factor" Nature Biotechnology, vol. 17, No. 3, pp. 287-291.

Lee, S.C., et al. (2004a). Ectopic expression of a cold-inducible transcription factor, CBF1/DREB1b, in transgenic rice (*Oryza sativa* L.). Mol Cells 18, 107-114.

Kennison (1995). The Polycomb and trithorax group proteins of *Drosophila*: transregulators of homeotic gene function. Annu. Rev. Genet. 29:289-303.

Kim et al. (Jun. 1997) Isolation of a novel class of bZIP transcription factors that interact with ABA-responsive and embryo-specification elements in the Dc3 promoter using a modified yeast one-hybrid system. Plant J. 11:1237-1251.

Kitajima, Sakihito, et al (Jun. 2000) Characterization of gene expression of NsERFs, transcription factors of basic PR genes from *Nicotiana sylvestris*. Plant and Cell Physiology, vol. 41, No. 6, pp. 817-824.

Klein et al., A new family of DNA binding proteins includes putative transcriptional regulators of . . . , Mol. Gen. Genet. (Jan. 15, 1996) 250:7-16.

Klug and Schwabe, Zinc fingers, FASEB J. (May 1995) 9:597-604.

Kranz, H.D. et al. (1998) Towards functional characterization of the members of the R2R3 MYB gene family from *Arabidopsis thaliana*. The Plant Journal vol. 16, No. 2, pp. 263-276.

Kuhlemeier et al., The Pea rbcS-3A Promoter Mediates Light Responsiveness but not Organ Specificity, The Plant Cell (Apr. 1989) 1:471-478.

Lacombe, et al. (2001). The Identity of Plant Glutamate Receptors. Science Journal, vol. 292: 1486-1487.

Lazar, et al. (1988). Transforming Growth Factor ox: Mutation of Aspartic Acid 47 and Leucine 48 Results in Different Biological Activities. Mol. Cell Biol. 8: 1247-1252.

Leckband, G. et al: "transformation and expression of a stilbene synthase gene of *Vitis vinifera* I. in barley and wheat for increased fungal resistance" theoretical and applied genetics, springer, Berlin, DE, vol. 96, No. 8, 1998, pp. 1004-1012, XP000923027.

Lee, J.H., et al. (2004b). The ethylene-responsive factor like protein 1 (CaERFLP1) of hot pepper (*Capsicum annuum* L.) interacts in vitro with both GCC and DRE/CRT sequences with different binding affinities: possible biological roles of CaERFLP1 in response to pathogen infection and high salinity . . . Plant Mol Biol 55, 61-81.

Lee J H. et al. (Oct. 1995), Derepression of the activity of genetically engineered heat shock factor causes constitutive synthesis of heat shock proteins and increased themotolerance in transgenic *Arabidopsis*. Plant Journal, vol. 8, No. 4, pp. 603-612.

Leggewie, G. et al. (1998). A cDNA from potato with homology to DNAJ is identical to a hitherto unidentified gene that is induced upon tuberization in potato and upon flowering in tobacco. Plant Physiol. 117, 1127.

Lin, et al. (Dec. 1999). Sequence and analysis of chromosome 2 of the plant *Arabidopsis thaliana*. Nature 402 (6763):761-768.

Littlewood et al. (1994) Transcription factors 2: helix-loop-helix. Prot. Profile 1:639-709.

Liu Qiang et al. (Aug. 1998) "Two transcription factors, DREB1 and DREB2, with an EREBP/AP2 DNA binding domain separate two cellular signal transduction pathways in drought-and low-termperature-responsive gene expression, respectivley, in *Arabidopsis*" Plant Cell 10: 1391-1406.

Lorenzo, O., et al. (2003). Ethylene Response Factor1 integrates signals from ethylene and jasmonate pathways in plant defense. Plant Cell 15, 165-178.

Lu and Ferl (Oct. 1995). The Electronic Plant Gene Register. Plant Physiol. 109:721-723.

Luo et al. (1996) Origin of floral asymmetry in *Antirrhinum*. Nature 383:794-799.

Ma and Ptashne (1987) A new class of yeast transcriptional activators. Cell 51:113-119.

Ma Q-H et al. (1998) Seed-specific expression of the isopentenyl transferase gene (IPT) in transgenic tobacco Austral. J Plant Physiol. 25: 53-59.

Martin, G.B., et al. (1993). Map-based cloning of a protein kinase gene conferring disease resistance in tomato. Science 262, 1432-1436.

Martin and Paz-Ares, MYB transcription factors in plants, Trends in Genetics (Feb. 1997) 13:67-73.

Mayer, K. et al. (2001) Conservation of microstructure between a sequenced region of the genome of rice and multiple segments of the genome of *Arabidopsis thaliana*. Genome Res. 11 (7), 1167-1174 (2001).

Mayer, et al. (Dec. 1999). Sequence and analysis of chromosome 4 of the plant *Arabidopsis thaliana*. Nature 402(6763):769-77.

Mazarei, et al. (Jun. 2002). Identification and characterization of a soybean ethylene-responsive element-binding protein gene whose mRNA expression changes during soybean cyst nematode infection. Mol. Plant Microbe Interact. 15(6):577-586.

Meissner, Ruth et al. (Oct. 1999) "Function search in a large transcription factor gene family in *Arabidopsis*: Assessing the potential of reverse genetics to identify insertional mutations in R2R3 MYB genes" Plant Cell vol. 11, No. 10, pp. 1827-1840.

Menke, et al. (1999). A novel jasmonate-and elicitor-responsive element in the periwinkle secondary metabolite biosynthetic gene Str interacts with a jasmonate-and elicitor-inducible AP2-domain transcription factor, ORCA2. EMBO J. 18 (16), 4455-4463.

Moore et al. (1998). A transcription activation system for regulated gene expression in transgenic plants Proc. Natl. Acad. Sci. 95:376-381.

Nakano,T., et al. (2006). Genome-wide analysis of the ERF gene family in *Arabidopsis* and rice. Plant Physiol. 140 (2), 411-432.

Newman, et al. (1994). Genes galore: a summary of methods for accessing results from large-scale partial sequencing of anonymous *Arabidopsis* cDNA clones (Plant Physiol. 106, 1241-1255 (1994)).

Odell et al. (Feb. 28, 1985). Identification of DNA sequences required for activity of the cauliflower mosaic virus 35S promoter. Nature 313:810-812.

Odell et al., Seed-Specific Gene Activation Mediated by the Cre/lox Site-Specific Recombination System, Plant Physiol. (Oct. 1994) 106:447-458.

Ohl et al., Functional Properties of a Phenylalanine Ammonia-Lyase Promoter from *Arabidopsis*, The Plant Cell (Sep. 1990) 2:837-848.

Ohme-Takagi, M., and Shinshi, H. (1990). Structure and expression of a tobacco a-1,3-glucanase gene. Plant Mol. Biol. 15, 941-946.

Ohme-Takagi, M., and Shinshi, H. (1995). Ethylene-inducible DNA binding proteins that interact with an ethylene-responsive element. Plant Cell 7, 173-182.

Ohta, et al. (2001) Repression domains of class II ERF transcriptional repressors share an essential motif for active repression. Plant Cell 13 (8), 1959-1968.

Okamuro, J.K., et al. (1997). The AP2 domain of APETALA2 defines a large new family of DNA binding proteins in *Arabidopsis*. Proc Natl Acad Sci U S A 94, 7076-7081.

Oldroyd et al. (Aug. 1998) Genetically engineered broad-spectrum disease resistance in tomato. Plant Biol. 95:10300-10305.

Onate-Sanchez, L., and Singh, K.B. (2002). Identification of *Arabidopsis* ethylene-responsive element binding factors with distinct induction kinetics after pathogen infection. Plant Physiol 128, 1313-1322.

NCBI acc. No. AAC27694 (gi: 2895184) (Feb. 19, 1998); Robert,L. S., et al. "CONSTANS homolog [*Brassica napus*]"; source: *Brassica napus* (rape); Title: "Conserved structure and function of the flowering time gene Constans in *Brassicaceae*" (Unpublished).

Park, J.M., et al. (2001). Overexpression of the tobacco Tsi1 gene encoding an EREBP/AP2-type transcription factor enhances resistance against pathogen attack and osmotic stress in tobacco. Plant Cell 13, 1035-1046.

Prandl, R., et al., (May 1998) HSF3, a new heat shock factor from *Arabidopsis thaliana*, derepresses the heat shock response and confers thermotolerance when overexpressed in transgenic plants. Molecular and General Genetics, vol. 258, pp. 269-278.

Quattrocchio, et al. (1998) Analysis of bHLH and MYB domain proteins: species-specific regulatory differences are caused by divergent evolution of target anthocyanin genes. The Plant Journal, vol. 13, No. 4, pp. 475-488.

Ratcliffe et al. (Mar. 1999) Separation of shoot and floral identity in *Arabidopsis*. Development vol. 126, pp. 1109-1120.

Reeves and Nissen (1990) J. Biol. Chem. 265:8573-8582.

Rensink, et al. (2005) Analyzing the potato abiotic stress transcriptome using expressed sequence tags. Genome 48 (4), 598-605.

Rice Chromosome 10 Sequencing Consortium (Jun. 2003) In-depth view of structure, activity, and evolution of rice chromosome 10. Science 300(5625):1566-9.

Riechmann, et al. (Aug. 1996). DNA-binding properties of *Arabidopsis* MADS domain homeotic proteins APETALA1, APETALA3, PISTILLATA and AGAMOUS. Nucleic Acids Research. vol. 24, No. 16, pp. 3134-3141.

Riechmann, et al. (May 1996) Dimerization specificity of *Arabidopsis* MADS domain homeotic proteins APETALA1, APETALA3, PISTILLATA, and AGAMOUS. Proc. Natl. Acad. Sci. USA. vol. 93, pp. 4793-4798.

Riechmann, J.L., and Meyerowitz, E.M. (1998). The AP2/EREBP family of plant transcription factors. Biol Chem 379, 633-646.

Riechmann, J.L., and Ratcliffe, O.J. (2000). A genomic perspective on plant transcription factors. Curr Opin Plant Biol 3, 423-434.

Riechmann and Meyerowitz (Oct. 1997) MADS domain proteins in plant development. Bio. Chem. 378:1079-1101.

Riechmann, et al. (Jul. 1997) Determination of floral organ identity by *Arabidopsis* MADS domain homeotic proteins AP1, AP3, PI, and AG is independent of their DNA-binding specificity. Molecular Biol. of the Cell, pp. 1243-1259.

Riechmann, J.L., et al. (2000). *Arabidopsis* transcription factors: genome-wide comparative analysis among eukaryotes. Science 290, 2105-2110.

Ringli et al., Specific interaction of the tomato bZIP transcription factor VSF-1 with a non-palindromic DNA sequence that controls vascular gene expression, Plant Mol. Biol. (Aug. 1998) 37:977-988.

Rouse et al., Changes in Auxin Response from Mutations in an AUX/IAA Gene, Science 279:1371 (Feb. 1998) 279:1371-1373.

Sakuma, Y., et al. (2002). DNA-binding specificity of the ERF/AP2 domain of Arabidopsis DREBs, transcription factors involved in dehydration- and cold-inducible gene expression. Biochem Biophys Res Commun 290, 998-1009.

Sakurai, et al. (Jan. 2005). RARGE: a large-scale database of RIKEN *Arabidopsis* resources ranging from transcriptome to phenome. Nucleic Acids Res. (2005), 33(Database Issue): D647-50.

Salmi, et al. (2005). Profile and analysis of gene expression changes during early development in germinating spores of *Ceratopteris richardii*. Plant Physiol. 138 (3), 1734-1745.

Sasaki, T. et al. (2002). The genome sequence and structure of rice chromosome 1. Nature 420 (6913), 312-316.

Sato, et al. (1998). Structural analysis of *Arabidopsis thaliana* chromosome 5. IV. Sequence features of the regions of 1,456,315 bp covered by nineteen physically assigned P1 and AC clones. DNA Rsearch, Universal Academy Press, JP, vol. 5, 1998, pp. 41-54.

Sato, et al. (2000). Structural analysis of *Arabidopsis thaliana* chromosome 5. X. Sequence features of the regions of 3,076,755 bp covered by sixty P1 and TAC clones. DNA Res. 7 (1), 31-63 (2000).

Sato, et. al. (Apr. 28, 2000). Structural analysis of *Arabidopsis thaliana* chromosome 3. I. Sequence features of the regions of 4,504,864 bp covered by sixty P1 and TAC clones. DNA Res. 7(2):131-135.

Schaffner and Sheen, Maize rbcS Promoter Depends on Sequence Elements Not Found in Dicot recS Promoters, The Plant Cell (Sep. 1991) 3:997-1012.

Seki, et al. (Epub Mar. 21, 2002). Functional annotation of a full-length Arabidopsis cDNA collection. Science Apr. 2002; 296(5565):141-5.

Shi et al., Gibberellin and abscisie acids regulate GAST1 expression at the level of transcription, Plant Mol. Biol. (Dec. 1998) 38:1053-1060.

Shin, R., et al. (2002). Ectopic expression of Tsi1 in transgenic hot pepper plants enhances host resistance to viral, bacterial, and oomycete pathogens. Mol Plant Microbe Interact 15, 983-989.

Siebertz et al. (1989) cis-analysis of the wound-inducible promoter wun1 in transgenic tobacco plants and histochemical localization of its expression. Plant Cell 1:961-968.

Smalle, J. (1998) The trihelix DNA-binding motif in higher plants is not restricted to the transcription factors GT-1 and GT-2. Proc. Natl. Acad. Sci. USA vol. 95, pp. 3318-3322.

Soares, M.B., et al. (1994). Construction and characterization of a normalized cDNA library. Proc. Natl. Acad. Sci. U.S.A. 91, 9228-9232.

Solano et al. (1998) "Nuclear events in ethylene signaling: a transcriptional cascade mediated by ethylene-insensitive3 and ethylene-response-factor1" Genes Devel. 12:3703-3714.

Solano et al. (1998). Ethylene gas: perception, signaling and response. Curr. Opin. Plant Biol. 1:393-398.

Souer et al. (Apr. 19, 1996). The No Apical Meristem Gene of *Petunia* is Required for Pattern Formation in Embryos and . . . , Cell 85:159-170.

Stepanova et al. (Oct. 2000) Ethylene signaling: from mutants to molecules. Curr. Opin. Plant Biol. 3:353-360.

Stockinger, E.J., et al. (1997). *Arabidopsis thaliana* CBF1 encodes an AP2 domain-containing transcriptional activator that binds to the C-repeat/DRE, a cis-acting DNA regulatory element that stimulates transcription in response to low temperature and water deficit. Proc Natl Acad Sci U S A 94, 1035-1040.

Sung et al. (Mar. 2000). Developmentally regulated expression of two MADS-box genes, MdMADS3 and MdMADS4, in the morphogenesis of flower buds and fruits in apple. Planta. vol. 210, pp. 519-528.

Sung et al. (Aug. 1999) Characterization of MdMADS2, a member of the *Squamosa* subfamily of genes, in apple. Plant Physiol. 120: 969-978.

Suzuki, Kaoru et al. (1998). Immediate early induction of mRNAs for ethylene-resonsive transcription factors in tobacco leaf strips after cutting. Plant Journal, 15: 657-665.

Tang, et al. (1999). Overexpression of Pto activates defense responses and confers broad resistance. Plant Cell 11 (1), 15-29.

Thara et al. (1999) *Pseudomonas syringae* pv tomato induces the expression of tomato EREBP-like genes pti4 and pti5 independent of ethylene, salicylate and jasmonate. Plant J. 20:475-483.

Theologis, et al. (Dec. 2000) Sequence and analysis of chromosome 1 of the plant *Arabidopsis thaliana*. Nature 408(6814):816-20.

Thilmony et al. (1995). Expression of the Tomato Pto Gene in Tobacco Enhances Resistance to *Pseudomonas syringae* pv tabaci Expressing avrPto. Plant Cell 7:1529-1536.

Tournier, B., et al. (2003). New members of the tomato ERF family show specific expression pattern and diverse DNA-binding capacity to the GCC box element. FEBS Lett 550: 149-154.

Tucker et al. (Jul. 1994) Crystal structure of the adenovirus DNA binding protein reveals a hook-on model for cooperative DNA binding. EMBO J. 13: 2994-3002.

Wada, T., et al (1997) "Epidermal cell differentiation in *Arabidopsis* determined by a Myb homolog, CPC"Science 277, No. 5329 1113-1116.

Wang Zhi-Yong et al: "(1997) A Myb-related transcription factor is involved in the phytochrome regulation of an *Arabidopsis* Lhcb gene" Plant Cell 9: 491-507.

Wang Z-Y et al (1998) "Constitutive expression of the Circadian Clock Associated 1 (CCA1) gene disrupts circadian rhythms and suppresses its own expression" Cell 93: 1207-1217.

Xu, P., et al. (1998). Identification of a novel DNA-binding protein to osmotin promoter. Science in China, Series C: Life Sciences, 41(6), 657-663.

Urao et al. (Nov. 1993) "An *Arabidopsis* MYB Homolog is induced by dehydration stress and its gene product binds to the conserved MYB recognition sequence." Plant Cell, 5: 1529-1539.

Van Der Fits and Memelink (2000). ORCA3, a jasmonate-responsive transcriptional regulator of plant primary and secondary metabolism. Science 289 (5477), 295-297.

Van Der Fits and Memelink (Jan. 2001). The jasmonate-inducible AP2/ERF-domain transcription factor ORCA3 activates gene expression via interaction with a jasmonate-responsive promoter element. Plant J. 25(1 ):43-53.

Van Der Kop et al., Selection of *Arabidopsis* mutants overexpressing genes driven by the promoter . . . , Plant Mol. Biol. (Mar. 1999) 39:979-990.

Weigel, D. (1995). The APETALA2 domain is related to a novel type of DNA binding domain. Plant Cell 7, 388-389.

White, et al. (2000) A new set of *Arabidopsis* expressed sequence tags from developing seeds. The metabolic pathway from carbohydrates to seed oil. Plant Physiol. 124 (4), 1582-1594.

Willmott et al., Dnase1 footprints suggest the involvement of at least three types of transcription factors in the regulation . . . , Plant Mol. Biol. (Nov. 1998) 38:817-825.

Winicov et al. (Dec. 1998) "New molecular approaches to improving salt tolerance in crop plants." Annals of Botany, vol. 82, No. 6, pp. 705-710.

Winicov Ilga et al., (Jun. 1999) Transgenic overexpression of the transcription factor Alfin1 enhances expression of the endogenous MsPRP2 gene in alfalfa and improves salinity tolerance of the plants. Plant Physiology vol. 120, No. 2, pp. 473-480.

Wu et al., The *Arabidopsis* 14-3-3 Multigene Family, Plant Physiol. (Aug. 1997) 114:1421-1431.

Wu et al. (Jan. 2002) Functional analysis of tomato Pti4 in *Arabidopsis*. Plant Physiol. 128:30-37.

Xu, et al. (Nov. 1998). A nitrilase-like protein interacts with GCC box DNA-binding proteins involved in ethylene and defense responses. Plant Physiol. 118(3):867-74.

Xue, G. et al. (2004) HvDRF1 is involved in abscisic acid-mediated gene regulation in barley and produces two forms of AP2 transcription activators, interacting preferably with a CT-rich element. The Plant Journal, vol. 37, pp. 326-339.

Yamada, K., et al. (2003). Empirical analysis of transcriptional activity in the *Arabidopsis* genome. Science 302 (5646), 842-846.

Shewmaker, C. K., et al: "Seed-specific overexpression of phytoene synthase: increase in carotenoids and other metabolic effects" Plant Journal, Blackwell Scientific Publications, Oxford, GB, vol. 20, No. 4, 1999, pp. 401-412, XP002969263 ISSN: 0960-7412.

Zhang et al., Expression of Antisense or Sense RNA of an Ankyrin Repeat-Containing Gene . . . , The Plant Cell (Dec. 1992) 4:1575-1588.

Zhou, J., et al. (1997). The Pto kinase conferring resistance to tomato bacterial speck disease interacts with proteins that bind a cis-element of pathogenesis-related genes. Embo J 16, 3207-3218.

Zhou et al. (1995). Molecular cloning of a small DNA binding protein with specificity for a tissue-specific negative element within the rps1 promoter. Nucleic Acids Res. 23:1165-1169.

Li, Z., et al: "PEI1, an embryo-specific zinc finger protein gene required for heart-stage embryo formation in *Arabidopsis*" Plant Cell, vol. 10, No. 3, Mar. 1998, pp. 383-398, XP002302043 ISSN: 1040-4651.

Robert, L.S., et al. (1998). Conserved structure and function of the *Arabidopsis* flowering time gene CONSTANS in *Brassica napus*. Plant Mol. Biol. 37 (5), 763-772 (1998).

Putterril, J.J., et al. The flowering-time gene CONSTANS and homologue CONSTANS Like 1 (accession Nos. Y10555 and Y10556) exist as a tandem repeat on chromosome 5 of *Arabidopsis* (PGR97-077) Plant Physiol. 114, 396-396 (1997).

U.S. Appl. No. 11/986,992, Kumimoto, R. et al., Entire document.

U.S. Appl. No. 12/157,329, Zhang, J. et al., Entire document.

U.S. Appl. No. 12/169,527, Zhang, J. et al., Entire document.

U.S. Appl. No. 12/154,154, Century, K. et al., Entire document.

U.S. Appl. No. 11/981,733, Ratcliffe, O. et al., Entire document.

\* cited by examiner

FIG. 2A

```
G4243 (1986)  MGEEVKTSEYD------------------EERVMEWEMGLPTANDLTPLSQPLIPPELASAFSI
G4244 (1988)  MGEEVKTSEYD------------------EERVMEWEAGLPTANDLTPLSQPLIPPELASAFSI
G4245 (1990)  MGEEVSLTDYES-----------SGGNDDRLLWEIGLPDVDDLTPLNMQLIPSELAAAFRI
G4241 (1992)  MGEEA-PEEYEL--------------GGGEDERVMEWEAGLPGADELTPLSQPLVPAGLAAAFRI
G4240 (1994)  MGEEA-VDDYELHMVCYGGGGGGSEDERVMEWESGLPGADELTPLSQPLVPAGLAAAFRI
G1435 (1796)  MGKEVMVSDYGDD---DGEDAGGGDEYRIPEWEIGLPNGDDLTPLSQYLVPSILALAFSM
G2741 (1984)  MGEEVQMSDY---------DVSGDGD--RVSEWEMGLPSDEDLASLSYSLIPPNLAMAFSI

G4243 (1986)  SPEPHRTLLEVNRASRNTLSTIRGGG--SVHQAFSSNNNNNHHYDGDGDGG-DEEEYDDA
G4244 (1988)  LPEPHRTLLDVNRASRNTLSTLRGGGG-SVHQAFSSNNN-HNYDGDGDGGVEEEEEEDD
G4245 (1990)  SPELSKTMTDVNRASQNTFSSLQRWHS-QDMASMNNSNFKTFSYERSREETVTERDETDL
G4241 (1992)  PPEPGRTLLDVHRASAATVSRLRRAS--SSS-----SSSFPAFASKGAG-AGADEAE----
G4240 (1994)  PPEAGRTLLDVHRASAATVSRLRRAPPSSSGSGSSSFAPFHPAARGDEGADSSA----
G1435 (1796)  IPERSRTIHDVNRASQITLSSLR-------SSTNASSVMEEVVDRVESSVPGSDPKKQKKS
G2741 (1984)  TPERSRTIQDVNRASETTLSSLRGGSS-GPNTSSSNNNVEEEDRVGSSSPGSDSKKQKTS

G4243 (1986)  DRDGSGSDSRKQRKIDCGVAEEAD--SAVRTETSAERTAVK----RPRLVWTPQLHKRFVD
G4244 (1988)  DRDGSGPDSRKQRKIDCGAAEEAD--SAVQTETSAERTAVK----RPRLVWTPQLHKRFVD
G4245 (1990)  IREGS--DSRKLRRVESGGTEEAD--SSLCNENFADDSSAKTLKRPRLVWTPQLHKRFIE
G4241 (1992)  -----------SGGGANGG-----NGNTNNNSS--------KRARLVWTPQLHKRFVE
G4240 (1994)  -----------AGGGAAATT----NGNNNMSSSS--------KRPRLVWTPQLHKRFVD
G1435 (1796)  --DGG---------EAAAVEDS--TAEEGDSGPEDASGKTSKRPRLVWTPQLHKRFVD
G2741 (1984)  NGDGD--------DGGGVDPDSAMAAEEGDSGTEDLSGKTLKRPRLVWTPQLHKRFVD
```

```
G4243 (1986) VVAHLGIKNAVPKTIMQLMNVEGLTRENVASHLQKYRLYLKRMQGLSNEGP---SSSDQLF
G4244 (1988) VVAHLGIKNAVPKTIMQLMNVEGLTRENVASHLQKYRLYLKRMQGLSNEGP---SASDQLF
G4245 (1990) VVAHLGIKGAVPKTIMQLMNVEGLTRENVAGHLQKYRLYTKRMQ---PNEGP---SSSDHLL
G4241 (1992) VVAHLGMKNAVPKTIMQLMNVEGLTRENVASHLQKYRLYVKRMQGLSNEGP---SPSDHIF
G4240 (1994) VVAHLGMKNAVPKTIMQLMNVEGLTRENVASHLQKYRLYVKRMQGLSDEGP---SPSDHIF
G1435 (1796) VVAHLGIKNAVPKTIMQLMNVEGLTRENVASHLQKYRLYLKRIQGLTTEEDPYSSSDQLF
G2741 (1984) VVAHLGIKNAVPKTIMQLMNVEGLTRENVASHLQKYRLYLKRMQGLTNEGP---SASDKLF

G4243 (1986) ASTAVPQSLHDSAPPSAHSN----------------GHGHLPVPMMSMPYPPPMMSMP
G4244 (1988) ASTPVPQSLHDSAPPSNHSNGHGHGHSNGRGHGHGHLSVPMMSMPYPPPLMSMP
G4245 (1990) TSTPATEIMRESSESGHLRN----------------TNGHMAMPTL-MPYQQQMVAMP
G4241 (1992) ASTPVPHASLHDQVPSPYHP----------------------------------
G4240 (1994) ASTPVPQSLVHEVPMYGTMAS----------------------------------
G1435 (1796) SSTPVPPQSFQD---GGGSN----------------GKLGVPVP----VPSMVP--
G2741 (1984) SSTPVPPQSFQDIGGGGGSS----------------GNVGVPIPGAYGTQQMQ--

G4243 (1986) YPPPMMSGMPHAHGHMGIPMPNSSAT------------SAYHPYNMLHQRDW
G4244 (1988) YPPPMMSGMP--HGHMGIPMPNSSAT------------SAYHPYNMLHQRDW
G4245 (1990) --------MMGMPN-GGHVGMPVGYGGGPPL-------GFHHHYNVVQQRDW
G4241 (1992) --------HPHHHSYNNAAYAATVSS------------YHHYHHANH---
G4240 (1994) --------GGQAYHNHNGMGGGGYQYQ-----------YHHYHHAHK---
G1435 (1796) --------IPGYGNQMGMQGYYQQYSNH------GN---ESNQYMMQQNKFG
G2741 (1984) --------MPVYAHHMGMQGYHHQNHHDPYHQNHRHHHGAGGNGAFESNPYMMQQNKFG
```

FIG. 2B

| | | |
|---|---|---|
| G4243 | (1986) | P-------HLAPNDK |
| G4244 | (1988) | P-------HLAPNDK |
| G4245 | (1990) | SGNNFGYYHPVASNDK |
| G4241 | (1992) | --------------- |
| G4240 | (1994) | --------------- |
| G1435 | (1796) | TMVTYPSVGGGDVNDK |
| G2741 | (1984) | SMASYPSVGGGSANEN |

FIG. 2C

TRANSCRIPTION FACTORS FOR INCREASING YIELD

RELATED APPLICATION INFORMATION

The present patent application is a continuation-in-part application of prior U.S. patent application Ser. No. 09/713,994, filed Nov. 16, 2000, which is now abandoned, and the present patent application claims the benefit of the following three U.S. provisional patent applications: application Ser. No. 60/166,228 filed Nov. 17, 1999; application Ser. No. 60/197,899, filed Apr. 17, 2000; and application Ser. No. 60/227,439, filed Aug. 22, 2000. The entire contents of each of these applications are hereby incorporated by reference.

JOINT RESEARCH AGREEMENT

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement, said agreement having been in effect on or before the date the claimed invention was made.

FIELD OF THE INVENTION

This invention relates to the field of plant biology. More particularly, the present invention pertains to compositions and methods for phenotypically modifying a plant.

BACKGROUND OF THE INVENTION

Transcription factors can modulate gene expression, either increasing or decreasing (inducing or repressing) the rate of transcription. This modulation results in differential levels of gene expression at various developmental stages, in different tissues and cell types, and in response to different exogenous (e.g., environmental) and endogenous stimuli throughout the life cycle of the organism.

Because transcription factors are key controlling elements of biological pathways, altering the expression levels of one or more transcription factors can change entire biological pathways in an organism. For example, manipulation of the levels of selected transcription factors may result in increased expression of economically useful proteins or metabolic chemicals in plants or to improve other agriculturally relevant characteristics such as to increase yield. Therefore, manipulating transcription factor levels in a plant offers tremendous potential in agricultural biotechnology for modifying a plant's traits such as improved yield from commercially important plant species.

One factor affecting yield is the number of plants that can be grown per acre. For crop species, planting or population density varies from a crop to a crop, from one growing region to another, and from year to year. Using corn as an example, the average prevailing density in 2000 was in the range of 20,000-25,000 plants per acre in Missouri, USA. A desirable higher population density (a measure of yield) would be at least 22,000 plants per acre, and a more desirable higher population density would be at least 28,000 plants per acre, more preferably at least 34,000 plants per acre, and most preferably at least 40,000 plants per acre. The average prevailing densities per acre of a few other examples of crop plants in the USA in the year 2000 were: wheat 1,000,000-1,500,000; rice 650,000-900,000; soybean 150,000-200,000, canola 260,000-350,000, sunflower 17,000-23,000 and cotton 28,000-55,000 plants per acre (Cheikh et al. (2003) U.S. Patent Application No. 20030101479). A desirable higher population density for each of these examples, as well as other valuable species of plants, would be at least 10% higher than the average prevailing density or yield.

The present invention provides novel transcription factors useful for modifying a plant's phenotype in desirable ways.

SUMMARY OF THE INVENTION

The present invention pertains to a transgenic plant having that has an improved trait relative to a control plant. The improved trait may include, for example, larger size, larger seeds, greater yield, darker green, increased rate of photosynthesis, more tolerance to osmotic stress, more drought tolerance, more heat tolerance, more salt tolerance, more cold tolerance, more tolerance to low nitrogen, early flowering, delayed flowering, more resistance to disease, more seed protein, and more seed oil relative to the control plant. The transgenic plant will generally comprise an expression vector that comprises a recombinant polynucleotide of the invention, that is, a nucleic acid sequence that encodes a polypeptide sequence that is related to any of SEQ ID NO: 110, 112, 116, 120, 124, 128, 131, 135, 139, 143, 147, 151, 155, 159, 163, 167, 171, 175, 179, 183, 187, 191, 195, 199, 203, 207, 211, 215, 219, 223, 227, 231, 235, 239, 243, 247, 251, 255, 259, 263, 267, 271, 275, 280, 284, 288, 292, 296, 299, 303, 306, 309, 313, 317, 321, 325, 329, 333, 337, 341, 345, 349, 353, 357, 361, 365, 369, 373, 377, 381, 385, 389, 393, 397, 401, 404, 406, 409, 413, 416, 419, 422, 425, 428, 431, 435, 439, 443, 447, 451, 454, 458, 462, 465, 468, 471, 475, 478, 482, 485, 489, 493, 497, 501, 505, 509, 512, 515, 519, 522, 526, 530, 534, 538, 542, 546, 550, 553, 557, 561, 565, 568, 571, 574, 577, 581, 585, 588, 591, 594, 597, 601, 605, 609, 613, 616, 620, 624, 628, 632, 636, 640, 644, 648, 652, 656, 660, 664, 667, 671, 674, 678, 682, 686, 689, 692, 696, 700, 704, 708, 712, 715, 719, 723, 727, 731, 734, 738, 741, 745, 749, 752, 756, 760, 762, 766, 770, 774, 778, 782, 786, 789, 793, 797, 801, 805, 809, 813, 816, 819, 823, 827, 831, 835, 839, 843, 847, 851, 855, 859, 863, 867, 871, 874, 878, 882, 886, 890, 894, 898, 901, 905, 909, 913, 917, 921, 925, 929, 933, 937, 941, 945, 949, 953, 957, 960, 963, 966, 970, 973, 976, 980, 984, 988, 992, 995, 999, 1003, 1007, 1011, 1015, 1019, 1023, 1027, 1031, 1037, 1041, 1045, 1049, 1052, 1056, 1060, 1064, 1067, 1071, 1075, 1078, 1081, 1085, 1089, 1093, 1097, 1101, 1104, 1108, 1112, 1116, 1120, 1123, 1126, 1130, 1134, 1138, 1142, 1145, 1148, 1151, 1154, 1157, 1161, 1165, 1169, 1173, 1177, 1181, 1185, 1188, 1192, 1195, 1199, 1203, 1207, 1211, 1215, 1219, 1222, 1226, 1229, 1233, 1236, 1240, 1243, 1247, 1251, 1254, 1258, 1262, 1266, 1269, 1273, 1277, 1281, 1285, 1289, 1293, 1297, 1300, 1304, 1308, 1311, 1314, 1318, 1322, 1326, 1330, 1334, 1338, 1342, 1346, 1350, 1354, 1358, 1361, 1365, 1369, 1372, 1376, 1380, 1384, 1388, 1392, 1396, 1400, 1404, 1408, 1411, 1415, 1419, 1423, 1427, 1431, 1435, 1439, 1443, 1446, 1449, 1452, 1455, 1459, 1463, 1467, 1470, 1474, 1477, 1481, 1488, 1492, 1495, 1499, 1503, 1507, 1511, 1515, 1519, 1522, 1526, 1530, 1533, 1537, 1541, 1545, 1549, 1553, 1557, 1561, 1565, 1568, 1572, 1576, 1579, 1583, 1586, 1589, 1593, 1596, 1598, 1602, 1604, 1608, 1611, 1614, 1617, 1620, 1624, 1628, 1632, 1636, 1640, 1645, 1648, 1652, 1656, 1660, 1664, 1668, 1672, 1676, 1680, 1684, 1688, 1692, 1696, 1700, 1704, 1707, 1711, 1715, 1719, 1722, 1726, 1729, 1733, 1737, 1741, 1745, 1749, 1753, 1757, 1761, 1765, 1769, 1773, 1777, 1781, 1785, 1789, 1793, 1796, 1800, 1803, 1806, 1809, 1812, 1816, 1820, 1824, 1827, 1831, 1835, 1838, 1841, 1844, 1846, 1850, 1853, 1857, 1861, 1865, 1869, 1873, 1877, 1881, 1885, 1889, 1893, 1897, 1901, 1904, 1908, 1912, 1916, 1920, 1924, 1928, 1932, 1935, 1939, 1943, 1949, 1957, 1961, 1964, 1967, 1970, 1973, 1977, 1981, 1984, 1986, 1988, 1990, 1992, 1994, 1996, 1998; and 1999-2007. Sequences that are related to the polypeptides listed in the sequence listing will have at least 46%, or at least 50%, or at least 53%, or at least 56%, or at least 61%, or at least 80%, or at least 85%, or at least 90%, or at least 100% amino acid identity to the polypeptides of the sequence listing, or comprise a conserved domain at least 80%, or at least 91%, or at least 95%, or at least 97%, or at least 100% identical to the conserved domain of a polypeptide selected from the sequence listing. The conserved domains of the polypeptides of the invention and/or found within the sequence listing are required for the function of regulating transcription and altering a trait in a transgenic plant. Transgenic plants of the invention that comprise polypeptides of the invention will have improved traits, relative to a control plant, said improved traits including larger size, larger seeds, greater yield, darker green color, increased rate of photosynthesis, more tolerance to osmotic stress, more drought tolerance, more heat tolerance, more salt tolerance, more cold tolerance, more tolerance to low nitrogen, early flowering, delayed flowering, more resistance to disease, more seed protein, and/or more seed oil relative to the control plant. The invention is also directed to methods for producing a transgenic plant, or increasing the size, yield, photosynthetic rate or yield of a plant. These methods are carried out with a target plant that is then transformed with an expression vector that encodes a polypeptide with a conserved domain at least 91%, 95%, or 97% identical to SEQ ID NO: 1995, the conserved domain of amino acids 146-194 of the G1435 polypeptide, SEQ ID NO: 1796, thus producing the transgenic plant.

BRIEF DESCRIPTION OF THE SEQUENCE LISTING AND DRAWINGS

FIG. 1 shows a conservative estimate of phylogenetic relationships among the orders of flowering plants (modified from Angiosperm Phylogeny Group (1998) Ann. Missouri Bot. Gard. 84: 1-49). Those plants with a single cotyledon (monocots) are a monophyletic clade nested within at least two major lineages of dicots; the eudicots are further divided into rosids and asterids. Arabidopsis is a rosid eudicot classified within the order Brassicales; rice is a member of the monocot order Poales. FIG. 1 was adapted from Daly et al. (2001) Plant Physiol. 127: 1328-1333.

FIGS. 2A-2C show a Clustal W alignment of the G1435 clade. SEQ ID NOs: appear in parentheses after each Gene IDentifier (GID). The highly conserved GARP domain is identified in FIGS. 2A-2B by the box that appears around the residues within these domains.

The Sequence Listing provides exemplary polynucleotide and polypeptide sequences of the invention. CD-ROMs Copy 1 and Copy 2, and the CRF copy of the Sequence Listing under CFR Section 1.821(e), are read-only memory computer-readable compact discs. Each contains a copy of the Sequence Listing in ASCII text format. The Sequence Listing is named "MB10022-2CIP.ST25.txt", the electronic file of the Sequence Listing contained on each of these CD-ROMs was created on Jun. 30, 2006, and is 4299 kilobytes in size. The copies of the Sequence Listing on the CD-ROM discs are hereby incorporated by reference in their entirety.

DETAILED DESCRIPTION

The present invention relates to polynucleotides and polypeptides, e.g. for modifying phenotypes of plants.

The polynucleotides of the invention encode plant transcription factors. The plant transcription factors are derived, e.g., from *Arabidopsis thaliana* and can belong, e.g., to one or more of the following transcription factor families: the AP2 (APETALA2) domain transcription factor family (Riechmann and Meyerowitz (1998) *J. Biol. Chem.* 379:633-646); the MYB transcription factor family (Martin and Paz-Ares (1997) *Trends Genet.* 13:67-73); the MADS domain transcription factor family (Riechmann and Meyerowitz (1997) *J. Biol. Chem.* 378:1079-1101); the WRKY protein family (Ishiguro and Nakamura (1994) *Mol. Gen. Genet.* 244:563-571); the ankyrin-repeat protein family (Zhang et al. (1992) *Plant Cell* 4:1575-1588); the miscellaneous protein (MISC) family (Kim et al. (1997) *Plant J.* 11:1237-1251); the zinc finger protein (Z) family (Klug and Schwabe (1995) *FASEB J.* 9: 597-604); the homeobox (HB) protein family (Duboule (1994) *Guidebook to the Homeobox Genes*, Oxford University Press); the CAAT-element binding proteins (Forsburg and Guarente (1989) *Genes Dev.* 3:1166-1178); the squamosa promoter binding proteins (SPB) (Klein et al. (1996) *Mol. Gen. Genet.* 1996 250:7-16); the NAM protein family; the IAA/AUX proteins (Rouse et al. (1998) *Science* 279:1371-1373); the HLH/MYC protein family (Littlewood et al. (1994) *Prot. Profile* 1:639-709); the DNA-binding protein (DBP) family (Tucker et al. (1994) *EMBO J.* 13:2994-3002); the bZIP family of transcription factors (Foster et al. (1994) *FASEB J.* 8:192-200); the BPF-1 protein (Box P-binding factor) family (da Costa e Silva et al. (1993) *Plant J.* 4:125-135); and the golden protein (GLD) family (Hall et al. (1998) *Plant Cell* 10:925-936).

In addition to methods for modifying a plant phenotype by employing one or more polynucleotides and polypeptides of the invention described herein, the polynucleotides and polypeptides of the invention have a variety of additional uses. These uses include their use in the recombinant production (i.e, expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like, of as substrates for cloning e.g., including digestion or ligation reactions, and for identifying exogenous or endogenous modulators of the transcription factors.

Definitions

A "polynucleotide" is a nucleic acid sequence comprising a plurality of polymerized nucleotide residues, e.g., at least about 15 consecutive polymerized nucleotide residues, optionally at least about 30 consecutive nucleotides, at least about 50 consecutive nucleotides. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single stranded or double stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "recombinant polypeptide" is a polypeptide produced by translation of a recombinant polynucleotide. An "isolated polypeptide," whether a naturally occurring or a recombinant polypeptide, is more enriched in (or out of) a cell than the polypeptide in its natural state in a wild type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type or other control standardized at 100%. Such an enrichment is not the result of a natural response of a wild type or other control plant. Alternatively, or additionally, the isolated polypeptide is separated from other cellular components with which it is typically associated, e.g., by any of the various protein purification methods herein.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like) and cells (for example, guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae (see for example, Daly et al. (2001) *Plant Physiol.* 127: 1328-1333 (2001), adapted from Ku et al. (2000) *Proc. Natl. Acad. Sci. USA* 97: 9121-9126; and see also Tudge (2000) in *The Variety of Life*, Oxford University Press, New York, N.Y. pp. 547-606.

The term "transgenic plant" refers to a plant that contains genetic material, not found in a control plant such as a wild type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation.

A transgenic plant may contain an expression vector or cassette. The expression cassette typically comprises a polypeptide-encoding sequence operably linked (i.e., under regulatory control of) to appropriate inducible or constitutive regulatory sequences that allow for the expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

The phrase "ectopically expression or altered expression" in reference to a polynucleotide indicates that the pattern of expression in, e.g., a transgenic plant or plant tissue, is different from the expression pattern in a wild type plant, control plant, or a reference plant of the same species. For example, the polynucleotide or polypeptide is expressed in a cell or tissue type other than a cell or tissue type in which the sequence is expressed in the control or wild type plant, or by expression at a time other than at the time the sequence is expressed in the control or wild type plant, or by a response to different inducible agents, such as hormones or environmental signals, or at different expression levels (either higher or lower) compared with those found in a control or wild type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "fragment" or "domain," with respect to a polypeptide, refers to a subsequence of the polypeptide. In some cases, the fragment or domain, is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA binding domain that binds to a DNA promoter region, an activation domain or a domain for protein-protein interactions. Fragments can vary in size from as few as 6 amino acids to the full length of the intact polypeptide, but are preferably at least about 30 amino acids in length and more preferably at least about 60 amino acids in length. In reference to a nucleotide sequence, "a fragment" refers to any subsequence of a polynucleotide, typically, of at least consecutive about 15 nucleotides, preferably at least about 30 nucleotides, more preferably at least about 50, of any of the sequences provided herein.

A "conserved domain" or "conserved region" as used herein refers to a region in heterologous polynucleotide or polypeptide sequences where there is a relatively high degree of sequence identity between the distinct sequences. A "GARP" domain", such as is found in a polypeptide member of GARP family, is an example of a conserved domain. With respect to polynucleotides encoding presently disclosed polypeptides, a conserved domain is preferably at least nine base pairs (bp) in length. A conserved domain with respect to presently disclosed polypeptides refers to a domain within a polypeptide family that exhibits a higher degree of sequence homology, such as at least about 80% sequence identity, or at least about 91% sequence identity, or at least about 95% sequence identity, or at least about 97% amino acid residue sequence identity, to a conserved domain of a polypeptide of the invention (e.g., SEQ ID NOs: 1999-2007). Sequences that possess or encode for conserved domains that meet these criteria of percentage identity, and that have comparable biological activity to the present polypeptide sequences, for example, those sequences that are members of the G1435 clade polypeptides, are encompassed by the invention. A fragment or domain can be referred to as outside a conserved domain, outside a consensus sequence, or outside a consensus DNA-binding site that is known to exist or that exists for a particular polypeptide class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains may be identified as regions or domains of identity to a specific consensus sequence (see, for example, Riechmann et al. (2000a) *Science* 290, 2105-2110; Riechmann, J. L., and Ratcliffe, O. J. (2000b) *Curr. Opin. Plant Biol.* 3, 423-434). Thus, by using alignment methods well known in the art, the conserved domains of the plant polypeptides, for example, for the GARP family of transcription factors), may be determined.

The polypeptide may comprise 1) a localization domain, 2) an activation domain, 3) a repression domain, 4) an oligomerization domain, or 5) a DNA-binding domain, or the like. The conserved domains of the polypeptides of the invention and/or that are found within the sequence listing are required for the function of regulating transcription and altering a trait in a transgenic plant of the invention. Altered traits that may be conferred to a transgenic plant of the invention may include larger size, larger seeds, greater yield, darker green, increased rate of photosynthesis, more tolerance to osmotic stress, more drought tolerance, more heat tolerance, more salt tolerance, more cold tolerance, more tolerance to low nitrogen, early flowering, delayed flowering, more resistance to disease, more seed protein, and more seed oil relative to a control plant.

Conserved domains for some examples of polypeptide sequences of the invention are listed in Table 4. Also, the polypeptides of Table 4 have conserved domains specifically indicated by amino acid coordinate start and stop sites. A comparison of the regions of these polypeptides allows one of skill in the art (see, for example, Reeves and Nissen (1990) *J. Biol. Chem.* 265, 8573-8582) to identify domains or conserved domains for any of the polypeptides listed or referred to in this disclosure.

The term "trait" refers to a physiological, morphological, biochemical or physical characteristic of a plant or particular plant material or cell. In some instances, this characteristic is visible to the human eye, such as seed or plant size, or can be measured by available biochemical techniques, such as the protein, starch or oil content of seed or leaves or by the observation of the expression level of genes, e.g., by employing Northern analysis, RT-PCR, microarray gene expression assays or reporter gene expression systems, or by agricultural observations such as stress tolerance, yield or pathogen tolerance.

"Trait modification" refers to a detectable difference in a characteristic in a plant ectopically expressing a polynucleotide or polypeptide of the present invention relative to a plant not doing so, such as a control or wild type plant. In some cases, the trait modification can be evaluated quantitatively. For example, the trait modification can entail at least about a 2% increase or decrease in an observed trait (difference), at least a 5% difference, at least about a 10% difference, at least about a 20% difference, at least about a 30%, at least about a 50%, at least about a 70%, or at least about a 100%, or an even greater difference. It is known that there can be a natural variation in the modified trait. Therefore, the trait modification observed entails a change of the normal distribution of the trait in the plants compared with the distribution observed in a control or a wild type plant.

Trait modifications of particular interest include those to seed (such as embryo or endosperm), fruit, root, flower, leaf, stem, shoot, seedling or the like, including: enhanced tolerance to environmental conditions including freezing, chilling, heat, drought, water saturation, radiation and ozone; improved tolerance to microbial, fungal or viral diseases; improved tolerance to pest infestations, including nematodes, mollicutes, parasitic higher plants or the like; decreased herbicide sensitivity; improved tolerance of heavy metals or enhanced ability to take up heavy metals; improved growth under poor photoconditions (e.g., low light and/or short day length), or changes in expression levels of genes of interest. Other phenotype that can be modified relate to the production of plant metabolites, such as variations in the production of taxol, tocopherol, tocotrienol, sterols, phytosterols, vitamins, wax monomers, anti-oxidants, amino acids, lignins, cellulose, tannins, prenyllipids (such as chlorophylls and carotenoids), glucosinolates, and terpenoids, enhanced or compositionally altered protein or oil production (especially in seeds), or modified sugar (insoluble or soluble) and/or starch composition. Physical plant characteristics that can be modified include cell development (such as the number of trichomes), fruit and seed size and number, yields of plant parts such as stems, leaves and roots, the stability of the seeds during storage, characteristics of the seed pod (e.g., susceptibility to shattering), root hair length and quantity, internode distances, or the quality of seed coat. Plant growth characteristics that can be modified include growth rate, germination rate of seeds, vigor of plants and seedlings, leaf and flower senescence, male sterility, apomixis, flowering time, flower abscission, rate of nitrogen uptake, biomass or transpiration characteristics, as well as plant architecture characteristics such as apical dominance, branching patterns, number of organs, organ identity, organ shape or size.

A "control plant" as used in the present invention refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present invention that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

Polypeptides and Polynucleotides of the Invention

The present invention provides, among other things, transcription factors (TFs), and transcription factor homologue polypeptides, and isolated or recombinant polynucleotides encoding the polypeptides. These polypeptides and polynucleotides may be employed to modify a plant's characteristic.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences were subsequently recovered by the rapid amplification of cDNA ends (RACE) procedure, using a commercially available kit according to the manufacturer's instructions. Where necessary, multiple rounds of RACE are performed to isolate 5' and 3' ends. The full length cDNA was then recovered by a routine end-to-end polymerase chain reaction (PCR) using primers specific to the isolated 5' and 3' ends. Exemplary sequences are provided in the Sequence Listing.

The polynucleotides of the invention were ectopically expressed in overexpressor or knockout plants and changes in the characteristics of the plants were observed. Therefore, the polynucleotides and polypeptides can be employed to improve the characteristics of plants.

Making Polynucleotides

The polynucleotides of the invention include sequences that encode transcription factors and transcription factor homologue polypeptides and sequences complementary thereto, as well as unique fragments of coding sequence, or sequence complementary thereto. Such polynucleotides can be, e.g., DNA or RNA, e.g., mRNA, cRNA, synthetic RNA, genomic DNA, cDNA synthetic DNA, oligonucleotides, etc. The polynucleotides are either double-stranded or single-stranded, and include either, or both sense (i.e., coding) sequences and antisense (i.e., non-coding, complementary) sequences. The polynucleotides include the coding sequence of a transcription factor, or transcription factor homologue polypeptide, in isolation, in combination with additional coding sequences (e.g., a purification tag, a localization signal, as a fusion-protein, as a pre-protein, or the like), in combination with non-coding sequences (e.g., introns or inteins, regulatory elements such as promoters, enhancers, terminators, and the like), and/or in a vector or host environment in which the polynucleotide encoding a transcription factor or transcription factor homologue polypeptide is an endogenous or exogenous gene.

A variety of methods exist for producing the polynucleotides of the invention. Procedures for identifying and isolating DNA clones are well known to those of skill in the art, and are described in, e.g., Berger and Kimmel, *Guide to Molecular Cloning Techniques, Methods in Enzymology* volume 152 Academic Press, Inc., San Diego, Calif. ("Berger"); Sambrook et al., *Molecular Cloning—A Laboratory Manual* (2nd Ed.), Vol. 1-3, Cold Spring Harbor Laboratory, Cold Spring Harbor, N.Y., 1989 ("Sambrook") and *Current Protocols in Molecular Biology*, F. M. Ausubel et al., eds., Current Protocols, a joint venture between Greene Publishing Associates, Inc. and John Wiley & Sons, Inc., (supplemented through 2000) ("Ausubel").

Alternatively, polynucleotides of the invention, can be produced by a variety of in vitro amplification methods adapted to the present invention by appropriate selection of specific or degenerate primers. Examples of protocols sufficient to direct persons of skill through in vitro amplification methods, including the polymerase chain reaction (PCR) the ligase chain reaction (LCR), Qbeta-replicase amplification and other RNA polymerase mediated techniques (e.g., NASBA), e.g., for the production of the homologous nucleic acids of the invention are found in Berger, Sambrook, and Ausubel, as well as Mullis et al., (1987) *PCR Protocols A Guide to Methods and Applications* (Innis et al. eds) Academic Press Inc. San Diego, Calif. (1990) (Innis). Improved methods for cloning in vitro amplified nucleic acids are described in Wallace et al., U.S. Pat. No. 5,426,039. Improved methods for amplifying large nucleic acids by PCR are summarized in Cheng et al. (1994) *Nature* 369: 684-685 and the references cited therein, in which PCR amplicons of up to 40 kb are generated. One of skill will appreciate that essentially any RNA can be converted into a double stranded DNA suitable for restriction digestion, PCR expansion and sequencing using reverse transcriptase and a polymerase. See, e.g., Ausubel, Sambrook and Berger, all supra.

Alternatively, polynucleotides and oligonucleotides of the invention can be assembled from fragments produced by solid-phase synthesis methods. Typically, fragments of up to approximately 100 bases are individually synthesized and then enzymatically or chemically ligated to produce a desired sequence, e.g., a polynucleotide encoding all or part of a transcription factor. For example, chemical synthesis using the phosphoramidite method is described, e.g., by Beaucage et al. (1981) *Tetrahedron Letters* 22:1859-69; and Matthes et al. (1984) *EMBO J.* 3:801-5. According to such methods, oligonucleotides are synthesized, purified, annealed to their complementary strand, ligated and then optionally cloned into suitable vectors. And if so desired, the polynucleotides and polypeptides of the invention can be custom ordered from any of a number of commercial suppliers.

Table 1 provides exemplary polynucleotide sequences of the invention. The table includes from left to right for each sequence: the SEQ ID No., the internal code reference number (GID), where the coding sequence is initiated and where the coding sequence terminates, and identification of any conserved domains for the translated polypeptide sequences maintaining the same coordinates of the polynucleotide sequence.

TABLE 1

Exemplary Polynucleotide Sequences of the Invention

| SEQ ID No. | GID | Coding Sequence Coordinates | Conserved Domain(s) in Amino Acid Coordinates |
|---|---|---|---|
| 1 | G188 | 50 ... 1096 | 175-222 |
| 2 | G616 | 129 ... 1211 | 39-95 |
| 3 | G19 | 70 ... 816 | 76-145 |
| 4 | G261 | 458 ... 1663 | 16-104 |
| 5 | G28 | 63 ... 869 | 145-213 |
| 6 | G869 | 428 ... 1402 | 109-177 |
| 7 | G237 | 1 ... 852 | 11-113 |
| 8 | G409 | 331 ... 1149 | 64-124 |
| 9 | G418 | 103 ... 2322 | 500-560 |
| 10 | G591 | 88 ... 1020 | 143-240 |
| 11 | G525 | 109 ... 966 | 23-167 |
| 12 | G545 | 55 ... 738 | 82-102, 136-154 |
| 13 | G865 | 282 ... 920 | 36-103 |
| 14 | G881 | 76 ... 1008 | 176-233 |
| 15 | G896 | 47 ... 1150 | 18-39 |
| 16 | G378 | 1 ... 726 | 196-237 |
| 17 | G569 | 184 ... 969 | 90-153 |
| 18 | G558 | 267 ... 1259 | 45-105 |
| 19 | G22 | 81 ... 761 | 89-157 |
| 20 | G225 | 157 ... 441 | 39-76 |
| 21 | G226 | 10 ... 348 | 28-78 |
| 22 | G256 | 312 ... 1310 | 13-115 |
| 23 | G419 | 381 ... 2213 | 392-452 |
| 24 | G464 | 41 ... 664 | 7-15, 70-80, 125-158, 183-219 |
| 25 | G482 | 188 ... 760 | 25-116 |
| 26 | G502 | 224 ... 1093 | 10-155 |

TABLE 1-continued

Exemplary Polynucleotide Sequences of the Invention

| SEQ ID No. | GID | Coding Sequence Coordinates | Conserved Domain(s) in Amino Acid Coordinates |
|---|---|---|---|
| 27 | G526 | 181 ... 1188 | 21-149 |
| 28 | G561 | 86 ... 1168 | 248-308 |
| 29 | G664 | 104 ... 952 | 13-116 |
| 30 | G682 | 1 ... 228 | 22-53 |
| 31 | G911 | 1 ... 480 | 86-129 |
| 32 | G964 | 162 ... 1013 | 126-186 |
| 33 | G394 | 82 ... 918 | 121-182 |
| 34 | G489 | 33 ... 695 | 57-156 |
| 35 | G214 | 238 ... 2064 | 22-71 |
| 36 | G229 | 41 ... 1156 | 14-120 |
| 37 | G241 | 46 ... 867 | 14-114 |
| 38 | G663 | 113 ... 862 | 9-111 |
| 39 | G776 | 76 ... 1431 | 27-175 |
| 40 | G778 | 50 ... 1249 | 220-267 |
| 41 | G883 | 67 ... 1041 | 245-302 |
| 42 | G938 | 1 ... 1755 | 96-104 |
| 43 | G1328 | 67 ... 1041 | 14-119 |
| 44 | G584 | 40 ... 1809 | 401-494 |
| 45 | G668 | 1 ... 1056 | 13-113 |
| 46 | G727 | 43 ... 1977 | 226-269 |
| 47 | G732 | 73 ... 588 | 31-91 |
| 48 | G9 | 81 ... 1139 | 62-127 |
| 49 | G428 | 97 ... 1032 | 229-292 |
| 50 | G1269 | 88 ... 951 | 27-83 |
| 51 | G1038 | 240 ... 1574 | 198-247 |
| 52 | G438 | 188 ... 2716 | 22-85 |
| 53 | G571 | 326 ... 1708 | 160-220 |
| 54 | G748 | 98 ... 1444 | 112-140 |
| 55 | G431 | 1 ... 1149 | 286-335 |
| 56 | G187 | 118 ... 1074 | 172-228 |
| 57 | G470 | 1 ... 2580 | 61-393 |
| 58 | G615 | 197 ... 1252 | 88-147 |
| 59 | G1073 | 62 ... 874 | 33-42, 78-175 |
| 60 | G26 | 73 ... 729 | 67-134 |
| 61 | G38 | 149 ... 1156 | 76-143 |
| 62 | G43 | 38 ... 643 | 104-172 |
| 63 | G207 | 16 ... 930 | 6-106 |
| 64 | G254 | 15 ... 923 | 62-106 |
| 65 | G263 | 48 ... 902 | 15-105 |
| 66 | G308 | 196 ... 1794 | 270-274 |
| 67 | G536 | 1 ... 768 | 226-233 |
| 68 | G680 | 338 ... 2275 | 24-70 |
| 69 | G867 | 64 ... 1098 | 59-124 |
| 70 | G912 | 20 ... 694 | 51-118 |
| 71 | G996 | 53 ... 1063 | 14-114 |
| 72 | G1068 | 150 ... 1310 | 143-150 |
| 73 | G1337 | 97 ... 1398 | 9-75 |
| 74 | G231 | 88 ... 888 | 14-118 |
| 75 | G274 | 172 ... 2037 | 108-572 |
| 76 | G307 | 1 ... 1764 | 323-339 |
| 77 | G346 | 1 ... 825 | 196-221 |
| 78 | G598 | 248 ... 1039 | 205-263 |
| 79 | G605 | 72 ... 1076 | 132-143 |
| 80 | G777 | 54 ... 914 | 47-101 |
| 81 | G1133 | 104 ... 1084 | 256-326 |
| 82 | G1266 | 62 ... 718 | 79-147 |
| 83 | G1324 | 54 ... 914 | 20-118 |
| 84 | G975 | 58 ... 657 | 4-71 |
| 85 | G157 | 31 ... 621 | 2-57 |
| 86 | G859 | 132 ... 569 | 2-57 |
| 87 | G1842 | 219 ... 809 | 2-57 |
| 88 | G1843 | 51 ... 653 | 2-57 |
| 89 | G1844 | 39 ... 635 | 2-57 |
| 90 | G861 | 158 ... 880 | 2-57 |
| 91 | G192 | 63 ... 959 | 128-185 |
| 92 | G234 | 106 ... 1035 | 14-115 |
| 93 | G361 | 54 ... 647 | 43-63 |
| 94 | G486 | 1 ... 420 | 5-66 |
| 95 | G994 | 180 ... 917 | 14-123 |
| 96 | G1335 | 56 ... 667 | 24-43, 131-144, 185-203 |
| 97 | G562 | 137 ... 1285 | 253-315 |
| 98 | G736 | 1 ... 513 | 54-111 |
| 99 | G1435 | 8 ... 904 | 146-194 |
| 100 | G180 | 54 ... 629 | 118-174 |
| 101 | G592 | 121 ... 1200 | 290-342 |
| 102 | G208 | 15 ... 725 | 14-116 |
| 103 | G658 | 17 ... 757 | 2-105 |
| 104 | G1334 | 76 ... 885 | 18-190 |
| 105 | G27 | 83 ... 622 | 37-104 |
| 106 | G740 | 25 ... 924 | 24-42, 232-268 |
| 107 | G559 | 89 ... 1285 | 203-264 |
| 108 | G1093 | 1 ... 531 | 105-148 |
| 109 | G725 | 46 ... 1122 | 39-87 |

Orthologs and Paralogs

Sequences homologous, i.e., that share significant sequence identity or similarity, to those provided in the Sequence Listing, derived from *Arabidopsis thaliana* or from other plants of choice are also an aspect of the invention. Homologous sequences can be derived from any plant including monocots and dicots and in particular agriculturally important plant species, including but not limited to, crops such as soybean, wheat, corn, potato, cotton, rice, oilseed rape (including canola), sunflower, alfalfa, sugarcane and turf; or fruits and vegetables, such as banana, blackberry, blueberry, strawberry, and raspberry, cantaloupe, carrot, cauliflower, coffee, cucumber, eggplant, grapes, honeydew, lettuce, mango, melon, onion, papaya, peas, peppers, pineapple, spinach, squash, sweet corn, tobacco, tomato, watermelon, rosaceous fruits (such as apple, peach, pear, cherry and plum) and vegetable brassicas (such as broccoli, cabbage, cauliflower, Brussels sprouts and kohlrabi). Other crops, fruits and vegetables whose phenotype can be changed include barley, rye, millet, sorghum, currant, avocado, citrus fruits such as oranges, lemons, grapefruit and tangerines, artichoke, cherries, nuts such as the walnut and peanut, endive, leek, roots, such as arrowroot, beet, cassava, turnip, radish, yam, and sweet potato, and beans. The homologous sequences may also be derived from woody species, such pine, poplar and eucalyptus.

Homologous sequences as described above can comprise orthologous or paralogous sequences. Several different methods are known by those of skill in the art for identifying and defining these functionally homologous sequences. General methods for identifying orthologs and paralogs, including phylogenetic methods, sequence similarity and hybridization methods, are described herein; an ortholog or paralog, including equivalogs, may be identified by one or more of the methods described below.

As described by Eisen (1998) *Genome Res.* 8: 163-167, evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen, supra). In fact, many specific examples exist in which gene function has been shown to correlate well with gene phylogeny (Eisen, supra). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen, supra).

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL Thompson et al. (1994) *Nucleic Acids Res.* 22: 4673-4680; et al. (1996) *Methods Enzymol.* 266: 383-402). Groups of similar genes can also be identified with pair-wise BLAST analysis (Feng and Doolittle (1987) *J. Mol. Evol.* 25: 351-360). For example, a clade of very similar MADS domain transcription factors from *Arabidopsis* all share a common function in flowering time (Ratcliffe et al. (2001) *Plant Physiol.* 126: 122-132), and a group of very similar AP2 domain transcription factors from *Arabidopsis* are involved in tolerance of plants to freezing (Gilmour et al. (1998) *Plant J.* 16: 433-442). Analysis of groups of similar genes with similar function that fall within one clade can yield sub-sequences that are particular to the clade. These sub-sequences, known as consensus sequences, can not only be used to define the sequences within each lade, but define the functions of these genes; genes within a clade may contain paralogous sequences, or orthologous sequences that share the same function (see also, for example, Mount (2001), in *Bioinformatics: Sequence and Genome Analysis*, Cold Spring Harbor Laboratory Press, Cold Spring Harbor, N.Y., p. 543).

Transcription factor gene sequences are conserved across diverse eukaryotic species lines (Goodrich et al. (1993) Cell 75: 519-530); Lin et al. (1991) Nature 353: 569-571; Sadowski et al. (1988) *Nature* 335: 563-564). Plants are no exception to this observation; diverse plant species possess transcription factors that have similar sequences and functions. Speciation, the production of new species from a parental species, gives rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994) supra; Higgins et al. (1996) *Methods Enzymol.* 266: 383-402) potential orthologous sequences can be placed into the phylogenetic tree and their relationship to genes from the species of interest can be determined. Orthologous sequences can also be identified by a reciprocal BLAST strategy. Once an orthologous sequence has been identified, the function of the ortholog can be deduced from the identified function of the reference sequence.

By using a phylogenetic analysis, one skilled in the art would recognize that the ability to predict similar functions conferred by closely-related polypeptides is predictable. This predictability has been confirmed by our own many studies in which we have found that a wide variety of polypeptides have orthologous or closely-related homologous sequences that function as does the first, closely-related reference sequence. For example, distinct transcription factors, including:

(i) AP2 family *Arabidopsis* G47 (found in US patent publication 20040019925A1), a phylogenetically-related sequence from soybean, and two phylogenetically-related homologs from rice all can confer greater tolerance to drought, hyperosmotic stress, or delayed flowering as compared to control plants;

(ii) CAAT family *Arabidopsis* G481 (found in PCT patent publication WO2004076638), and numerous phylogenetically-related sequences from dicots and monocots can confer greater tolerance to drought-related stress as compared to control plants;

(iii) Myb-related *Arabidopsis* G682 (found in PCT patent publication WO2004076638) and numerous phylogenetically-related sequences from dicots and monocots can confer greater tolerance to heat, drought-related stress, cold, and salt as compared to control plants;

(iv) WRKY family *Arabidopsis* G1274 (found in U.S. patent application Ser. No. 10/666,642) and numerous closely-related sequences from dicots and monocots have been shown to confer increased water deprivation tolerance, and (v) AT-hook family soy sequence G3456 (found in US patent publication 20040128712A1) and numerous phylogenetically-related sequences from dicots and monocots, increased biomass compared to control plants when these sequences are overexpressed in plants.

The polypeptides sequences belong to distinct clades of polypeptides that include members from diverse species. In each case, most or all of the clade member sequences derived from both dicots and monocots have been shown to confer darker green coloration, increased photosynthetic rate, increased size, increased yield or delayed flowering, relative to control plants, when the sequences were overexpressed. These studies each demonstrate that evolutionarily conserved genes from diverse species are likely to function similarly (i.e., by regulating similar target sequences and controlling the same traits), and that polynucleotides from one species may be transformed into closely-related or distantly-related plant species to confer or improve traits.

As shown in Table 4, polypeptides that are phylogenetically related to the polypeptides of the invention may have at least 46%, 50%, 53%, 56%, 61% or 100% amino acid sequence identity with a member of the G1435 clade of transcription factors, or have conserved GARP domains that share at least 91%, 95%, 97%, or 100% amino acid sequence identity with a member of the G1435 clade of transcription factors, and have similar functions in that the polypeptides of the invention may, when overexpressed, confer at least one regulatory activity selected from the group consisting of greater increased photosynthetic rate, increased size, increased yield or delayed flowering, relative to control plants.

At the nucleotide level, the sequences of the invention will typically share at least about 84%, 85%, 87%, 89%, 90% or 100% sequence identity to one or more of the listed full-length sequences. These percentages were determined by BLASTn analysis comparing to the G1435 polynucleotide, SEQ ID NO: 99, the clade member nucleotide sequences of:

G4241 or G4240 (SEQ ID NOs: 1991 or 1993, each 84% identical to G1435, the BLASTn analysis comparing 103/122 bases of either sequence to G1435);

G4244 (SEQ ID NO: 1987, 85% identical to G1435, the BLASTn analysis comparing 89/105 bases to G1435);

G4243 (SEQ ID NO: 1985, 87% identical to G1435, the BLASTn analysis comparing 91/104 bases to G1435);

G4245 (SEQ ID NO: 1989, 89% identical to G1435, the BLASTn analysis comparing 35/39 bases to G1435); or G2741 (SEQ ID NO: 1983, 90% identical to G1435, the BLASTn analysis comparing 172/191 bases to G1435).

The degeneracy of the genetic code enables major variations in the nucleotide sequence of a polynucleotide while maintaining the amino acid sequence of the encoded protein.

Percentage identity can be determined electronically, e.g., by using the MEGALIGN program (DNASTAR, Inc. Madison, Wis.). The MEGALIGN program can create alignments between two or more sequences according to different methods, for example, the clustal method (see, for example, Higgins and Sharp (1988) *Gene* 73: 237-244. The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Software for performing BLAST analyses is publicly available, e.g., through the National Center for Biotechnology Information (see internet website at http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1990) *J. Mol. Biol.* 215: 403-410; Altschul (1993) *J. Mol. Evol.* 36: 290-300). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=4, and a comparison of both strands. For amino acid sequences, the BLASTP program uses as defaults a wordlength (W) of 3, an expectation (E) of 10, and the BLOSUM62 scoring matrix (see Henikoff and Henikoff (1989) *Proc. Natl. Acad. Sci. USA* 89:10915). Unless otherwise indicated for comparisons of predicted polynucleotides, "sequence identity" refers to the % sequence identity generated from a tblastx using the NCBI version of the algorithm at the default settings using gapped alignments with the filter "off" (see, for example, internet website at http://www.ncbi.nlm.nih.gov/).

Other techniques for alignment are described by Doolittle, ed. (1996) *Methods in Enzymology*, vol. 266: "Computer Methods for Macromolecular Sequence Analysis" Academic Press, Inc., San Diego, Calif., USA. Preferably, an alignment program that permits gaps in the sequence is utilized to align the sequences. The Smith-Waterman is one type of algorithm that permits gaps in sequence alignments (see Shpaer (1997) *Methods Mol. Biol.* 70: 173-187). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method (see, for example, Hein (1990) *Methods Enzymol.* 183: 626-645) Identity between sequences can also be determined by other methods known in the art, e.g., by varying hybridization conditions (see US Patent Application No. 20010010913).

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997) *Nucleic Acids Res.* 25: 217-221), PFAM, and other databases which contain previously identified and annotated motifs, sequences and gene functions. Methods that search for primary sequence patterns with secondary structure gap penalties (Smith et al. (1992) *Protein Engineering* 5: 35-51) as well as algorithms such as Basic Local Alignment Search Tool (BLAST; Altschul (1990) supra; Altschul et al. (1993) supra), BLOCKS (Henikoff and Henikoff (1991) Nucleic Acids Res. 19: 6565-6572), Hidden Markov Models (HMM; Eddy (1996) *Curr. Opin. Str. Biol.* 6: 361-365; Sonnhammer et al. (1997) *Proteins* 28: 405-420), and the like, can be used to manipulate and analyze polynucleotide and polypeptide sequences encoded by polynucleotides. These databases, algorithms and other methods are well known in the art and are described in Ausubel et al.

(1997) Short Protocols in Molecular Biology, John Wiley & Sons, New York, N.Y., unit 7.7, and in Meyers (1995) Molecular Biology and Biotechnology, Wiley VCH, New York, N.Y., p 856-853.

A further method for identifying or confirming that specific homologous sequences control the same function is by comparison of the transcript profile(s) obtained upon overexpression or knockout of two or more related polypeptides. Since transcript profiles are diagnostic for specific cellular states, one skilled in the art will appreciate that genes that have a highly similar transcript profile (e.g., with greater than 50% regulated transcripts in common, or with greater than 70% regulated transcripts in common, or with greater than 90% regulated transcripts in common) will have highly similar functions. Fowler and Thomashow (2002) *Plant Cell* 14: 1675-1690), have shown that three paralogous AP2 family genes (CBF1, CBF2 and CBF3) are induced upon cold treatment, and each of which can condition improved freezing tolerance, and all have highly similar transcript profiles. Once a polypeptide has been shown to provide a specific function, its transcript profile becomes a diagnostic tool to determine whether paralogs or orthologs have the same function.

Furthermore, methods using manual alignment of sequences similar or homologous to one or more polynucleotide sequences or one or more polypeptides encoded by the polynucleotide sequences may be used to identify regions of similarity and B-box zinc finger domains. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined. Such examples of tertiary structure may comprise predicted $\alpha$ helices, $\beta$-sheets, amphipathic helices, leucine zipper motifs, zinc finger motifs, proline-rich regions, cysteine repeat motifs, and the like.

Orthologs and paralogs of presently disclosed polypeptides may be cloned using compositions provided by the present invention according to methods well known in the art. cDNAs can be cloned using mRNA from a plant cell or tissue that expresses one of the present sequences. Appropriate mRNA sources may be identified by interrogating Northern blots with probes designed from the present sequences, after which a library is prepared from the mRNA obtained from a positive cell or tissue. Polypeptide-encoding cDNA is then isolated using, for example, PCR, using primers designed from a presently disclosed gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of *Arabidopsis* polypeptide sequences and their functionally similar orthologs are listed in Table 4 and the Sequence Listing. In addition to the sequences in Table 4 and the Sequence Listing, the invention encompasses isolated nucleotide sequences that are phylogenetically and structurally similar to sequences listed in the Sequence Listing) and can function in a plant by increasing yield and/or and abiotic stress tolerance when ectopically expressed in a plant.

Since a significant number of these sequences are phylogenetically and sequentially related to each other and have been shown to increase yield from a plant and/or abiotic stress tolerance, one skilled in the art would predict that other similar, phylogenetically related sequences falling within the present clades of polypeptides would also perform similar functions when ectopically expressed.

Identifying Nucleic Acids by Hybridization

Polynucleotides homologous to the sequences illustrated in the Sequence Listing can be identified, e.g., by hybridization to each other under stringent or under highly stringent conditions. Single stranded polynucleotides hybridize when they associate based on a variety of well characterized physico-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number), as described in more detail in the references cited above.

An example of stringent hybridization conditions for hybridization of complementary nucleic acids which have more than 100 complementary residues on a filter in a Southern or northern blot is about 5° C. to 20° C. lower than the thermal melting point (Tm) for the specific sequence at a defined ionic strength and pH. The $T_m$ is the temperature (under defined ionic strength and pH) at which 50% of the target sequence hybridizes to a perfectly matched probe. Nucleic acid molecules that hybridize under stringent conditions will typically hybridize to a probe based on either the entire cDNA or selected portions, e.g., to a unique subsequence, of the cDNA under wash conditions of 0.2×SSC to 2.0×SSC, 0.1% SDS at 50-65° C., for example 0.2×SSC, 0.1% SDS at 65° C. For identification of less closely related homologues washes can be performed at a lower temperature, e.g., 50° C. In general, stringency is increased by raising the wash temperature and/or decreasing the concentration of SSC.

As another example, stringent conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. Conditions can be selected such that a higher signal to noise ratio is observed in the particular assay which is used, e.g., about 15×, 25×, 35×, 50× or more. Accordingly, the subject nucleic acid hybridizes to the unique coding oligonucleotide with at least a 2× higher signal to noise ratio as compared to hybridization of the coding oligonucleotide to a nucleic acid encoding known polypeptide. Again, higher signal to noise ratios can be selected, e.g., about 5×, 10×, 25×, 35×, 50× or more. The particular signal will depend on the label used in the relevant assay, e.g., a fluorescent label, a calorimetric label, a radioactive label, or the like.

Alternatively, transcription factor homologue polypeptides can be obtained by screening an expression library using antibodies specific for one or more transcription factors. With the provision herein of the disclosed transcription factor, and transcription factor homologue nucleic acid sequences, the encoded polypeptide(s) can be expressed and purified in a heterologous expression system (e.g., *E. coli*) and used to raise antibodies (monoclonal or polyclonal) specific for the polypeptide(s) in question. Antibodies can also be raised against synthetic peptides derived from transcription factor, or transcription factor homologue, amino acid sequences.

Methods of raising antibodies are well known in the art and are described in Harlow and Lane (1988) *Antibodies: A Laboratory Manual*, Cold Spring Harbor Laboratory, New York. Such antibodies can then be used to screen an expression library produced from the plant from which it is desired to clone additional transcription factor homologues, using the methods described above. The selected cDNAs can be confirmed by sequencing and enzymatic activity.

Sequence Variations

It will readily be appreciated by those of skill in the art, that any of a variety of polynucleotide sequences are capable of encoding the transcription factors and transcription factor homologue polypeptides of the invention. Due to the degeneracy of the genetic code, many different polynucleotides can encode identical and/or substantially similar polypeptides in addition to those sequences illustrated in the Sequence Listing.

For example, Table 2 illustrates, e.g., that the codons AGC, AGT, TCA, TCC, TCG, and TCT all encode the same amino acid: serine. Accordingly, at each position in the sequence where there is a codon encoding serine, any of the above trinucleotide sequences can be used without altering the encoded polypeptide.

TABLE 2

| Amino acids | | | Codon |
|---|---|---|---|
| Alanine | Ala | A | GCA GCC GCG GCU |
| Cysteine | Cys | C | TGC TGT |
| Aspartic acid | Asp | D | GAC GAT |
| Glutamic acid | Glu | E | GAA GAG |
| Phenylalanine | Phe | F | TTC TTT |
| Glycine | Gly | G | GGA GGC GGG GGT |
| Histidine | His | H | CAC CAT |
| Isoleucine | Ile | I | ATA ATC ATT |
| Lysine | Lys | K | AAA AAG |
| Leucine | Leu | L | TTA TTG CTA CTC CTG CTT |
| Methionine | Met | M | ATG |
| Asparagine | Asn | N | AAC AAT |
| Proline | Pro | P | CCA CCC CCG CCT |
| Glutamine | Gln | Q | CAA CAG |
| Arginine | Arg | R | AGA AGG CGA CGC CGG CGT |
| Serine | Ser | S | AGG AGT TCA TCC TCG TCT |
| Threonine | Thr | T | ACA ACC ACG ACT |
| Valine | Val | V | GTA GTC GTG GTG GTT |
| Tryptophan | Trp | W | TGG |
| Tyrosine | Tyr | Y | TAC TAT |

Sequence alterations that do not change the amino acid sequence encoded by the polynucleotide are termed "silent" variations. With the exception of the codons ATG and TGG, encoding methionine and tryptophan, respectively, any of the possible codons for the same amino acid can be substituted by a variety of techniques, e.g., site-directed mutagenesis, available in the art. Accordingly, any and all such variations of a sequence selected from the above table are a feature of the invention.

In addition to silent variations, other conservative variations that alter one, or a few amino acids in the encoded polypeptide, can be made without altering the function of the polypeptide, these conservative variants are, likewise, a feature of the invention.

For example, substitutions, deletions and insertions introduced into the sequences provided in the Sequence Listing are also envisioned by the invention. Such sequence modifications can be engineered into a sequence by site-directed mutagenesis (Wu (ed.) *Meth. Enzymol.* (1993) vol. 217, Academic Press) or the other methods noted below. Amino acid substitutions are typically of single residues; insertions usually will be on the order of about from 1 to 10 amino acid residues; and deletions will range about from 1 to 30 residues. In preferred embodiments, deletions or insertions are made in adjacent pairs, e.g., a deletion of two residues or insertion of two residues. Substitutions, deletions, insertions or any combination thereof can be combined to arrive at a sequence. The mutations that are made in the polynucleotide encoding the transcription factor should not place the sequence out of reading frame and should not create complementary regions that could produce secondary mRNA structure. Preferably, the polypeptide encoded by the DNA performs the desired function.

Conservative substitutions are those in which at least one residue in the amino acid sequence has been removed and a different residue inserted in its place. Such substitutions generally are made in accordance with the Table 3 when it is desired to maintain the activity of the protein. Table 3 shows amino acids which can be substituted for an amino acid in a protein and which are typically regarded as conservative substitutions.

TABLE 3

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Substitutions that are less conservative than those in Table 3 can be selected by picking residues that differ more significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. The substitutions which in general are expected to produce the greatest changes in protein properties will be those in which (a) a hydrophilic residue, e.g., seryl or threonyl, is substituted for (or by) a hydrophobic residue, e.g., leucyl, isoleucyl, phenylalanyl, valyl or alanyl; (b) a cysteine or proline is substituted for (or by) any other residue; (c) a residue having an electropositive side chain, e.g., lysyl, arginyl, or histidyl, is substituted for (or by) an electronegative residue, e.g., glutamyl or aspartyl; or (d) a residue having a bulky side chain, e.g., phenylalanine, is substituted for (or by) one not having a side chain, e.g., glycine.

Further Modifying Sequences of the Invention—Mutation/Forced Evolution

In addition to generating silent or conservative substitutions as noted, above, the present invention optionally includes methods of modifying the sequences of the Sequence Listing. In the methods, nucleic acid or protein modification methods are used to alter the given sequences to produce new sequences and/or to chemically or enzymatically modify given sequences to change the properties of the nucleic acids or proteins.

Thus, in one embodiment, given nucleic acid sequences are modified, e.g., according to standard mutagenesis or artificial evolution methods to produce modified sequences. For example, Ausubel, supra, provides additional details on mutagenesis methods. Artificial forced evolution methods are described, e.g., by Stemmer (1994) *Nature* 370:389-391, and Stemmer (1994) *Proc. Natl. Acad. Sci. USA* 91:10747-10751. Many other mutation and evolution methods are also available and expected to be within the skill of the practitioner.

Similarly, chemical or enzymatic alteration of expressed nucleic acids and polypeptides can be performed by standard methods. For example, sequence can be modified by addition of lipids, sugars, peptides, organic or inorganic compounds, by the inclusion of modified nucleotides or amino acids, or the like. For example, protein modification techniques are illustrated in Ausubel, supra. Further details on chemical and enzymatic modifications can be found herein. These modification methods can be used to modify any given sequence, or to modify any sequence produced by the various mutation and artificial evolution modification methods noted herein.

Accordingly, the invention provides for modification of any given nucleic acid by mutation, evolution, chemical or enzymatic modification, or other available methods, as well as for the products produced by practicing such methods, e.g., using the sequences herein as a starting substrate for the various modification approaches.

For example, optimized coding sequence containing codons preferred by a particular prokaryotic or eukaryotic host can be used e.g., to increase the rate of translation or to produce recombinant RNA transcripts having desirable properties, such as a longer half-life, as compared with transcripts produced using a non-optimized sequence. Translation stop codons can also be modified to reflect host preference. For example, preferred stop codons for *S. cerevisiae* and mammals are TAA and TGA, respectively. The preferred stop codon for monocotyledonous plants is TGA, whereas insects and *E. coli* prefer to use TAA as the stop codon.

The polynucleotide sequences of the present invention can also be engineered in order to alter a coding sequence for a variety of reasons, including but not limited to, alterations which modify the sequence to facilitate cloning, processing and/or expression of the gene product. For example, alterations are optionally introduced using techniques which are well known in the art, e.g., site-directed mutagenesis, to insert new restriction sites, to alter glycosylation patterns, to change codon preference, to introduce splice sites, etc.

Furthermore, a fragment or domain derived from any of the polypeptides of the invention can be combined with domains derived from other transcription factors or synthetic domains to modify the biological activity of a transcription factor. For instance, a DNA binding domain derived from a transcription factor of the invention can be combined with the activation domain of another transcription factor or with a synthetic activation domain. A transcription activation domain assists in initiating transcription from a DNA binding site. Examples include the transcription activation region of VP16 or GAL4 (Moore et al. (1998) *Proc. Natl. Acad. Sci. USA* 95: 376-381; and Aoyama et al. (1995) *Plant Cell* 7:1773-1785), peptides derived from bacterial sequences (Ma and Ptashne (1987) *Cell* 51; 113-119) and synthetic peptides (Giniger and Ptashne, (1987) *Nature* 330:670-672).

Expression and Modification of Polypeptides

Typically, polynucleotide sequences of the invention are incorporated into recombinant DNA (or RNA) molecules that direct expression of polypeptides of the invention in appropriate host cells, transgenic plants, in vitro translation systems, or the like. Due to the inherent degeneracy of the genetic code, nucleic acid sequences which encode substantially the same or a functionally equivalent amino acid sequence can be substituted for any listed sequence to provide for cloning and expressing the relevant homologue.

Vectors, Promoters and Expression Systems

The present invention includes recombinant constructs comprising one or more of the nucleic acid sequences herein. The constructs typically comprise a vector, such as a plasmid, a cosmid, a phage, a virus (e.g., a plant virus), a bacterial artificial chromosome (BAC), a yeast artificial chromosome (YAC), or the like, into which a nucleic acid sequence of the invention has been inserted, in a forward or reverse orientation. In a preferred aspect of this embodiment, the construct further comprises regulatory sequences, including, for example, a promoter, operably linked to the sequence. Large numbers of suitable vectors and promoters are known to those of skill in the art, and are commercially available.

General texts which describe molecular biological techniques useful herein, including the use and production of vectors, promoters and many other relevant topics, include Berger, Sambrook and Ausubel, supra. Any of the identified sequences can be incorporated into a cassette or vector, e.g., for expression in plants. A number of expression vectors suitable for stable transformation of plant cells or for the establishment of transgenic plants have been described including those described in Weissbach and Weissbach, (1989) *Methods for Plant Molecular Biology*, Academic Press, and Gelvin et al., (1990) *Plant Molecular Biology Manual*, Kluwer Academic Publishers. Specific examples include those derived from a Ti plasmid of *Agrobacterium tumefaciens*, as well as those disclosed by Herrera-Estrella et al. (1983) *Nature* 303: 209, Bevan (1984) *Nucl Acid Res.* 12: 8711-8721, Klee (1985) *Bio/Technol.* 3: 637-642, for dicotyledonous plants.

Alternatively, non-Ti vectors can be used to transfer the DNA into monocotyledonous plants and cells by using free DNA delivery techniques. Such methods can involve, for example, the use of liposomes, electroporation, microprojectile bombardment, silicon carbide whiskers, and viruses. By using these methods transgenic plants such as wheat, rice (Christou (1991) *Bio/Technol.* 9: 957-962) and corn (Gordon-Kamm (1990) *Plant Cell* 2: 603-618) can be produced. An immature embryo can also be a good target tissue for monocots for direct DNA delivery techniques by using the particle gun (Weeks et al. (1993) *Plant Physiol.* 102: 1077-1084; Vasil (1993) *Bio/Technol.* 10: 667-674; Wan and Lemeaux (1994) *Plant Physiol.* 104: 37-48, and for *Agrobacterium*-mediated DNA transfer (Ishida et al. (1996) *Nature Biotech.* 14: 745-750).

Typically, plant transformation vectors include one or more cloned plant coding sequence (genomic or cDNA) under the transcriptional control of 5' and 3' regulatory sequences and a dominant selectable marker. Such plant transformation vectors typically also contain a promoter (e.g., a regulatory region controlling inducible or constitutive, environmentally- or developmentally-regulated, or cell- or tissue-specific expression), a transcription initiation start site, an RNA processing signal (such as intron splice sites), a transcription termination site, and/or a polyadenylation signal.

Examples of constitutive plant promoters which can be useful for expressing the TF sequence include: the cauliflower mosaic virus (CaMV) 35S promoter, which confers constitutive, high-level expression in most plant tissues (see, e.g., Odel et al. (1985) *Nature* 313:810); the nopaline synthase promoter (An et al. (1988) *Plant Physiol.* 88:547); and the octopine synthase promoter (Fromm et al. (1989) *Plant Cell* 1: 977).

A variety of plant gene promoters that regulate gene expression in response to environmental, hormonal, chemical, developmental signals, and in a tissue-active manner can be used for expression of a TF sequence in plants. Choice of a promoter is based largely on the phenotype of interest and is determined by such factors as tissue (e.g., seed, fruit, root, pollen, vascular tissue, flower, carpel, etc.), inducibility (e.g., in response to wounding, heat, cold, drought, light, pathogens, etc.), timing, developmental stage, and the like. Numerous known promoters have been characterized and can favorable be employed to promote expression of a polynucleotide of the invention in a transgenic plant or cell of interest. For example, tissue specific promoters include: seed-specific promoters (such as the napin, phaseolin or DC3 promoter described in U.S. Pat. No. 5,773,697), fruit-specific promoters that are active during fruit ripening (such as the dru 1 promoter (U.S. Pat. No. 5,783,393), or the 2A11 promoter (U.S. Pat. No. 4,943,674) and the tomato polygalacturonase promoter (Bird et al. (1988) *Plant Mol Biol.* 11:651), root-specific promoters, such as those disclosed in U.S. Pat. Nos. 5,618,988, 5,837,848 and 5,905,186, pollen-active promoters such as PTA29, PTA26 and PTA13 (U.S. Pat. No. 5,792,929), promoters active in vascular tissue (Ringli and Keller (1998) *Plant Mol. Biol.* 37:977-988), flower-specific (Kaiser et al, (1995) *Plant Mol. Biol.* 28:231-243), pollen (Baerson et al. (1994) *Plant Mol. Biol.* 26:1947-1959), carpels (Ohl et al. (1990) *Plant Cell* 2:837-848), pollen and ovules (Baerson et al. (1993) *Plant Mol. Biol.* 22:255-267), auxin-inducible promoters (such as that described in van der Kop et al. (1999) *Plant Mol. Biol.* 39:979-990 or Baumann et al. (1999) *Plant Cell* 11:323-334), cytokinin-inducible promoter (Guevara-Garcia (1998) *Plant Mol. Biol.* 38:743-753), promoters responsive to gibberellin (Shi et al. (1998) *Plant Mol. Biol.* 38:1053-1060, Willmott et al. (1998) 38:817-825) and the like. Additional promoters are those that elicit expression in response to heat (Ainley et al. (1993) *Plant Mol. Biol.* 22: 13-23), light (e.g., the pea rbcS-3A promoter, Kuhlemeier et al. (1989) *Plant Cell* 1:471, and the maize rbcS promoter, Schaffner and Sheen (1991) *Plant Cell* 3: 997); wounding (e.g., wunI, Siebertz et al. (1989) *Plant Cell* 1: 961); pathogens (such as the PR-1 promoter described in Buchel et al. (1999) *Plant Mol. Biol.* 40:387-396, and the PDF1.2 promoter described in Manners et al. (1998) *Plant Mol. Biol.* 38:1071-80), and chemicals such as methyl jasmonate or salicylic acid (Gatz et al. (1997) *Plant Mol. Biol.* 48: 89-108). In addition, the timing of the expression can be controlled by using promoters such as those acting at senescence (An and Amazon (1995) *Science* 270: 1986-1988); or late seed development (Odell et al. (1994) *Plant Physiol.* 106:447-458).

Plant expression vectors can also include RNA processing signals that can be positioned within, upstream or downstream of the coding sequence. In addition, the expression vectors can include additional regulatory sequences from the 3'-untranslated region of plant genes, e.g., a 3' terminator region to increase mRNA stability of the mRNA, such as the PI-II terminator region of potato or the octopine or nopaline synthase 3' terminator regions.

Additional Expression Elements

Specific initiation signals can aid in efficient translation of coding sequences. These signals can include, e.g., the ATG initiation codon and adjacent sequences. In cases where a coding sequence, its initiation codon and upstream sequences are inserted into the appropriate expression vector, no additional translational control signals may be needed. However, in cases where only coding sequence (e.g., a mature protein coding sequence), or a portion thereof, is inserted, exogenous transcriptional control signals including the ATG initiation codon can be separately provided. The initiation codon is provided in the correct reading frame to facilitate transcription. Exogenous transcriptional elements and initiation codons can be of various origins, both natural and synthetic. The efficiency of expression can be enhanced by the inclusion of enhancers appropriate to the cell system in use.

Expression Hosts

The present invention also relates to host cells which are transduced with vectors of the invention, and the production of polypeptides of the invention (including fragments thereof) by recombinant techniques. Host cells are genetically engineered (i.e, nucleic acids are introduced, e.g., transduced, transformed or transfected) with the vectors of this invention, which may be, for example, a cloning vector or an expression vector comprising the relevant nucleic acids herein. The vector is optionally a plasmid, a viral particle, a phage, a naked nucleic acids, etc. The engineered host cells can be cultured in conventional nutrient media modified as appropriate for activating promoters, selecting transformants, or amplifying the relevant gene. The culture conditions, such as temperature, pH and the like, are those previously used with the host cell selected for expression, and will be apparent to those skilled in the art and in the references cited herein, including, Sambrook and Ausubel.

The host cell can be a eukaryotic cell, such as a yeast cell, or a plant cell, or the host cell can be a prokaryotic cell, such as a bacterial cell. Plant protoplasts are also suitable for some applications. For example, the DNA fragments are introduced into plant tissues, cultured plant cells or plant protoplasts by standard methods including electroporation (Fromm et al., (1985) *Proc. Natl. Acad. Sci. USA* 82, 5824, infection by viral vectors such as cauliflower mosaic virus (CaMV) (Hohn et al., (1982) *Molecular Biology of Plant Tumors*, (Academic Press, New York) pp. 549-560; U.S. Pat. No. 4,407,956), high velocity ballistic penetration by small particles with the nucleic acid either within the matrix of small beads or particles, or on the surface (Klein et al., (1987) *Nature* 327, 70-73), use of pollen as vector (WO 85/01856), or use of *Agrobacterium tumefaciens* or *A. rhizogenes* carrying a T-DNA plasmid in which DNA fragments are cloned. The T-DNA plasmid is transmitted to plant cells upon infection by *Agrobacterium tumefaciens*, and a portion is stably integrated into the plant genome (Horsch et al. (1984) *Science* 233:496-498; Fraley et al. (1983) *Proc. Natl. Acad. Sci. USA* 80, 4803).

The cell can include a nucleic acid of the invention which encodes a polypeptide, wherein the cells expresses a polypeptide of the invention. The cell can also include vector sequences, or the like. Furthermore, cells and transgenic plants which include any polypeptide or nucleic acid above or throughout this specification, e.g., produced by transduction of a vector of the invention, are an additional feature of the invention.

For long-term, high-yield production of recombinant proteins, stable expression can be used. Host cells transformed with a nucleotide sequence encoding a polypeptide of the invention are optionally cultured under conditions suitable for the expression and recovery of the encoded protein from cell culture. The protein or fragment thereof produced by a recombinant cell may be secreted, membrane-bound, or contained intracellularly, depending on the sequence and/or the vector used. As will be understood by those of skill in the art, expression vectors containing polynucleotides encoding mature proteins of the invention can be designed with signal sequences which direct secretion of the mature polypeptides through a prokaryotic or eukaryotic cell membrane.

Modified Amino Acids

Polypeptides of the invention may contain one or more modified amino acids. The presence of modified amino acids may be advantageous in, for example, increasing polypeptide half-life, reducing polypeptide antigenicity or toxicity, increasing polypeptide storage stability, or the like. Amino acid(s) are modified, for example, co-translationally or post-translationally during recombinant production or modified by synthetic or chemical means.

Non-limiting examples of a modified amino acid include incorporation or other use of acetylated amino acids, glycosylated amino acids, sulfated amino acids, prenylated (e.g., farnesylated, geranylgeranylated) amino acids, PEG modified (e.g., "PEGylated") amino acids, biotinylated amino acids, carboxylated amino acids, phosphorylated amino acids, etc. References adequate to guide one of skill in the modification of amino acids are replete throughout the literature.

Identification of Additional Factors

A transcription factor provided by the present invention can also be used to identify additional endogenous or exogenous molecules that can affect a phenotype or trait of interest. On the one hand, such molecules include organic (small or large molecules) and/or inorganic compounds that affect expression of (i.e., regulate) a particular transcription factor. Alternatively, such molecules include endogenous molecules that are acted upon either at a transcriptional level by a transcription factor of the invention to modify a phenotype as desired. For example, the transcription factors can be employed to identify one or more downstream gene with which is subject to a regulatory effect of the transcription factor. In one approach, a transcription factor or transcription factor homologue of the invention is expressed in a host cell, e.g, a transgenic plant cell, tissue or explant, and expression products, either RNA or protein, of likely or random targets are monitored, e.g., by hybridization to a microarray of nucleic acid probes corresponding to genes expressed in a tissue or cell type of interest, by two-dimensional gel electrophoresis of protein products, or by any other method known in the art for assessing expression of gene products at the level of RNA or protein. Alternatively, a transcription factor of the invention can be used to identify promoter sequences (i.e., binding sites) involved in the regulation of a downstream target. After identifying a promoter sequence, interactions between the transcription factor and the promoter sequence can be modified by changing specific nucleotides in the promoter sequence or specific amino acids in the transcription factor that interact with the promoter sequence to alter a plant trait. Typically, transcription factor DNA binding sites are identified by gel shift assays. After identifying the promoter regions, the promoter region sequences can be employed in double-stranded DNA arrays to identify molecules that affect the interactions of the transcription factors with their promoters (Bulyk et al. (1999) *Nature Biotechnol.* 17:573-577).

The identified transcription factors are also useful to identify proteins that modify the activity of the transcription factor. Such modification can occur by covalent modification, such as by phosphorylation, or by protein-protein (homo or -heteropolymer) interactions. Any method suitable for detecting protein-protein interactions can be employed. Among the methods that can be employed are co-immunoprecipitation, cross-linking and co-purification through gradients or chromatographic columns, and the two-hybrid yeast system.

The two-hybrid system detects protein interactions in vivo and is described in Chien, et al., (1991), *Proc. Natl. Acad. Sci. USA* 88, 9578-9582 and is commercially available from Clontech (Palo Alto, Calif.). In such a system, plasmids are constructed that encode two hybrid proteins: one consists of the DNA-binding domain of a transcription activator protein fused to the TF polypeptide and the other consists of the transcription activator protein's activation domain fused to an unknown protein that is encoded by a cDNA that has been recombined into the plasmid as part of a cDNA library. The DNA-binding domain fusion plasmid and the cDNA library are transformed into a strain of the yeast *Saccharomyces cerevisiae* that contains a reporter gene (e.g., lacZ) whose regulatory region contains the transcription activator's binding site. Either hybrid protein alone cannot activate transcription of the reporter gene. Interaction of the two hybrid proteins reconstitutes the functional activator protein and results in expression of the reporter gene, which is detected by an assay for the reporter gene product. Then, the library plasmids responsible for reporter gene expression are isolated and sequenced to identify the proteins encoded by the library plasmids. After identifying proteins that interact with the transcription factors, assays for compounds that interfere with the TF protein-protein interactions can be preformed.

Identification of Modulators

In addition to the intracellular molecules described above, extracellular molecules that alter activity or expression of a transcription factor, either directly or indirectly, can be identified. For example, the methods can entail first placing a candidate molecule in contact with a plant or plant cell. The molecule can be introduced by topical administration, such as spraying or soaking of a plant, and then the molecule's effect on the expression or activity of the TF polypeptide or the expression of the polynucleotide monitored. Changes in the expression of the TF polypeptide can be monitored by use of polyclonal or monoclonal antibodies, gel electrophoresis or the like. Changes in the expression of the corresponding polynucleotide sequence can be detected by use of microarrays, Northern blots, quantitative PCR, or any other technique for monitoring changes in mRNA expression. These techniques are exemplified in Ausubel et al. (eds) *Current Protocols in Molecular Biology*, John Wiley & Sons (1998). Such changes in the expression levels can be correlated with modified plant traits and thus identified molecules can be useful for soaking or spraying on fruit, vegetable and grain crops to modify traits in plants.

Essentially any available composition can be tested for modulatory activity of expression or activity of any nucleic acid or polypeptide herein. Thus, available libraries of compounds such as chemicals, polypeptides, nucleic acids and the like can be tested for modulatory activity. Often, potential modulator compounds can be dissolved in aqueous or organic (e.g., DMSO-based) solutions for easy delivery to the cell or plant of interest in which the activity of the modulator is to be tested. Optionally, the assays are designed to screen large modulator composition libraries by automating the assay steps and providing compounds from any convenient source to assays, which are typically run in parallel (e.g., in microtiter formats on microtiter plates in robotic assays).

In one embodiment, high throughput screening methods involve providing a combinatorial library containing a large number of potential compounds (potential modulator compounds). Such "combinatorial chemical libraries" are then screened in one or more assays, as described herein, to identify those library members (particular chemical species or subclasses) that display a desired characteristic activity. The compounds thus identified can serve as target compounds.

A combinatorial chemical library can be, e.g., a collection of diverse chemical compounds generated by chemical synthesis or biological synthesis. For example, a combinatorial chemical library such as a polypeptide library is formed by combining a set of chemical building blocks (e.g., in one example, amino acids) in every possible way for a given compound length (i.e., the number of amino acids in a polypeptide compound of a set length). Exemplary libraries include peptide libraries, nucleic acid libraries, antibody libraries (see, e.g., Vaughn et al. (1996) *Nature Biotechnol.* 14:309-314 and PCT/US96/10287), carbohydrate libraries (see, e.g., Liang et al. *Science* (1996) 274:1520-1522 and U.S. Pat. No. 5,593,853), peptide nucleic acid libraries (see, e.g., U.S. Pat. No. 5,539,083), and small organic molecule libraries (see, e.g., benzodiazepines, Baum (1993) *Chem Eng. News* January 18, page 33; isoprenoids, U.S. Pat. No. 5,569,588; thiazolidinones and metathiazanones, U.S. Pat. No. 5,549,974; pyrrolidines, U.S. Pat. Nos. 5,525,735 and 5,519,134; morpholino compounds, U.S. Pat. No. 5,506,337) and the like.

Preparation and screening of combinatorial or other libraries is well known to those of skill in the art. Such combinatorial chemical libraries include, but are not limited to, peptide libraries (see, e.g., U.S. Pat. No. 5,010,175, Furka (1991) *Int. J. Pept. Prot. Res.* 37:487-493 and Houghton et al. *Nature* (1991) 354:84-88). Other chemistries for generating chemical diversity libraries can also be used.

In addition, as noted, compound screening equipment for high-throughput screening is generally available, e.g., using any of a number of well known robotic systems that have also been developed for solution phase chemistries useful in assay systems. These systems include automated workstations including an automated synthesis apparatus and robotic systems utilizing robotic arms. Any of the above devices are suitable for use with the present invention, e.g., for high-throughput screening of potential modulators. The nature and implementation of modifications to these devices (if any) so that they can operate as discussed herein will be apparent to persons skilled in the relevant art.

Indeed, entire high throughput screening systems are commercially available. These systems typically automate entire procedures including all sample and reagent pipetting, liquid dispensing, timed incubations, and final readings of the microplate in detector(s) appropriate for the assay. These configurable systems provide high throughput and rapid start up as well as a high degree of flexibility and customization. Similarly, microfluidic implementations of screening are also commercially available.

The manufacturers of such systems provide detailed protocols the various high throughput. Thus, for example, Zymark Corp. provides technical bulletins describing screening systems for detecting the modulation of gene transcription, ligand binding, and the like. The integrated systems herein, in addition to providing for sequence alignment and, optionally, synthesis of relevant nucleic acids, can include such screening apparatus to identify modulators that have an effect on one or more polynucleotides or polypeptides according to the present invention.

In some assays it is desirable to have positive controls to ensure that the components of the assays are working properly. At least two types of positive controls are appropriate. That is, known transcriptional activators or inhibitors can be incubated with cells/plants/etc. in one sample of the assay, and the resulting increase/decrease in transcription can be detected by measuring the resulting increase in RNA/protein expression, etc., according to the methods herein. It will be appreciated that modulators can also be combined with transcriptional activators or inhibitors to find modulators which inhibit transcriptional activation or transcriptional repression. Either expression of the nucleic acids and proteins herein or any additional nucleic acids or proteins activated by the nucleic acids or proteins herein, or both, can be monitored.

In an embodiment, the invention provides a method for identifying compositions that modulate the activity or expression of a polynucleotide or polypeptide of the invention. For example, a test compound, whether a small or large molecule, is placed in contact with a cell, plant (or plant tissue or explant), or composition comprising the polynucleotide or polypeptide of interest and a resulting effect on the cell, plant, (or tissue or explant) or composition is evaluated by monitoring, either directly or indirectly, one or more of: expression level of the polynucleotide or polypeptide, activity (or modulation of the activity) of the polynucleotide or polypeptide. In some cases, an alteration in a plant phenotype can be detected following contact of a plant (or plant cell, or tissue or explant) with the putative modulator, e.g., by modulation of expression or activity of a polynucleotide or polypeptide of the invention.

Subsequences

Also contemplated are uses of polynucleotides, also referred to herein as oligonucleotides, typically having at least 12 bases, preferably at least 15, more preferably at least 20, 30, or 50 bases, which hybridize under at least highly stringent (or ultra-high stringent or ultra-ultra-high stringent conditions) conditions to a polynucleotide sequence described above. The polynucleotides may be used as probes, primers, sense and antisense agents, and the like, according to methods as noted supra.

Subsequences of the polynucleotides of the invention, including polynucleotide fragments and oligonucleotides are useful as nucleic acid probes and primers. An oligonucleotide suitable for use as a probe or primer is at least about 15 nucleotides in length, more often at least about 18 nucleotides, often at least about 21 nucleotides, frequently at least about 30 nucleotides, or about 40 nucleotides, or more in length. A nucleic acid probe is useful in hybridization protocols, e.g., to identify additional polypeptide homologues of the invention, including protocols for microarray experiments. Primers can be annealed to a complementary target DNA strand by nucleic acid hybridization to form a hybrid between the primer and the target DNA strand, and then extended along the target DNA strand by a DNA polymerase enzyme. Primer pairs can be used for amplification of a nucleic acid sequence, e.g., by the polymerase chain reaction (PCR) or other nucleic-acid amplification methods. See Sambrook and Ausubel, supra.

In addition, the invention includes an isolated or recombinant polypeptide including a subsequence of at least about 15 contiguous amino acids encoded by the recombinant or isolated polynucleotides of the invention. For example, such polypeptides, or domains or fragments thereof, can be used as immunogens, e.g., to produce antibodies specific for the polypeptide sequence, or as probes for detecting a sequence of interest. A subsequence can range in size from about 15 amino acids in length up to and including the full length of the polypeptide.

Introduction to the GARP Family

The acronym GARP was adopted to describe this family of transcription factors based on three of the founding members of the family: maize GOLDEN2, the ARR B class of *Arabidopsis* response regulator homologs, and Psr1 of *Chlamydomonas reinhardtii* (Riechmann et al. (2000) *Science* 290: 2105-2110). These proteins share a putative DNA binding domain with limited homology to the myb superfamily of transcription factors (Sakai et al. (1998) *Plant Cell Physiol.* 39: 1232-1239), particularly to a family of Myb-related proteins that includes the circadian regulatory protein CCA1 (Riechmann et al. 2000) supra). Distant homology of this domain is also evident to the TEA DNA binding domain found in a number of regulatory genes from fungi, insects, and mammals (Burglin (1991) *Cell* 66: 11-12; Hall et al. (1998) *Plant Cell* 10: 925-36). The TEA domain is predicted to form two α helices that are implicated in DNA binding (Burglin (1991) supra). For simplicity, this putative DNA binding domain is referred to as the GARP domain. The GARP domain is a highly conserved stretch of 49-50 amino acids that begins with an invariant tryptophan residue and ends in a motif with the consensus sequence SHLQKYRL (SEQ ID NO: 2008), in which the first four amino acids appear to be invariant.

The founding member of the GARP family is the maize GOLDEN2 (G2) gene (Hall et al. (1998) supra). Maize uses the C4 pathway of photosynthesis, where photosynthetic carbon fixation reactions are segregated between the mesophyll and bundle sheath cells. The g2 mutation perturbs the specialized development of the bundle sheath cells and expression of the C4 photosynthetic pathway enzymes. Evidence provided by G2-GUS fusions indicates that G2 is localized to the nucleus. The GARP domain was subsequently found in a *Chlamydomonas reinhardtii* protein, PSR1, that is a nuclear-localized regulator of phosphorus metabolism (Wykoff et al. (1999) *Proc. Natl. Acad. Sci. USA* 96: 15336-15341) as well as in a tobacco protein submitted to GenBank as a transfactor, WREBP-1 (acc. no. AB017693).

Fifty-six GARP genes are present in *Arabidopsis*, and these fall into two major classes. The first class consists of proteins that contain the GARP domain as the only recognizable motif (44 genes). G2, PSR1, and WREBP-1 are of this type. The second class also contains an N terminal domain with similarity to bacterial response regulators (12 genes). These proteins have been termed ARR for *Arabidopsis* Response Regulator (Sakai et al. (1998) supra), or ARP for *Arabidopsis* Receiver-like Protein (acc. no. AJ005194).

The response regulator class of GARP proteins is of particular interest because of the growing evidence that phosphorelay signal transduction systems, with homology to prokaryotic two-component systems, are functional in plants. The simplest bacterial two-component systems consist of a sensor kinase and a response regulator protein. The sensor kinase autophosphorylates on a histidine residue, and the rate of autophosphorylation is modified by input from a sensor domain. The phosphate group is then transferred to an aspartate residue on the response regulator. In prokaryotes the response regulator is usually a transcription factor that activates downstream responses, although some response regulators have different modes of action. Phosphorelay systems of greater complexity are known, where the phosphate is passed through one or more intermediary phosphotransmitter proteins before phosphorylation of the response regulator. Other variations include proteins with fused sensor kinase and receiver domains (hybrid kinases), and the *Arabidopsis* ETR1 protein is a eukaryotic example of this class (for reviews see D'Agostino and Kieber (1999) *Trends Biochem Sci.* 24: 452-456); Chang and Stewart (1998) *Plant Physiol.* 117: 723-731). The response regulator class of GARP proteins is a subset of a group of putative *Arabidopsis* response regulators that has been termed the type-B response regulators. The type-A response regulators in contrast lack a putative DNA binding domain (D'Agostino and Kieber (1999) supra). The type-B response regulators are likely to be the functional equivalents of bacterial response regulators, which receive a signal from a sensor kinase and activate transcription. ARR type-B proteins have been shown to bind DNA (Sakai et al. (2000) *Plant J.* 24: 703-711; Lohrmann et al. (2001) *Mol. Genet. Genomics* 265: 2-13), and to interact with histidine phosphotransmitter proteins (Imamura et al. (1999) *Plant Cell Physiol.* 40: 733-742).

Recent work implicates the response regulator GARP (ARR type-B) proteins in cytokinin signal transduction. ARR1, ARR2, and ARR10 activate transcription of the cytokinin-regulated type-A ARR gene ARR6 in protoplasts (Hwang and Sheen (2001) *Nature* 413: 383-389). The cytokinin receptor CRE1 was recently found to be a histidine kinase with fused receiver domains (Inoue et al. (2001) *Nature* 409: 1060-1063). A signal transduction pathway is postulated where CRE1 initiates a phosphorelay, the signal is transduced to the nucleus through histidine phosphotransmitter proteins, and these proteins interact with ARR type-B proteins to release these proteins from putative repressors, allowing them to activate transcription. Among the genes induced are those encoding ARR type-A proteins, which are thought to serve as negative feedback regulators of the pathway (Hwang and Sheen (2001) supra).

It should be noted that one *Arabidopsis* protein with a GARP domain, AT1, was identified in a screen for clones affecting cell shape when overexpressed in *Schizosaccharomyces pombe*. Overexpression of AT1 caused disordered actin staining and cell elongation similar to the effects of overexpressing cytoskeletal components. On the basis of these results, AT1 was characterized as a putative cytoskeletal protein, and annotated as such in GenBank (Xia et al, (1996) *Plant J.* 10:761-769). However, the effects that AT1 overexpression produced could also be due to inappropriate activation of "*S. pombe*" genes. Because AT1 was the only annotated protein with a GARP domain in the database for some time, a number of *Arabidopsis* proteins with GARP domains were annotated as putative cytoskeletal proteins, even though the annotation of AT1 is tenuous.

G1435, SEQ ID NO: 1796, encoded by SEQ ID NO: 99, is an example of a GARP family transcription factor polypeptide. A number of sequences have been found in other plant species that are closely-related to G1435. Table 4 shows a number of polypeptides of the invention and includes the SEQ ID NO: (Column 1), the species from which the sequence was derived and the Gene Identifier ("GID"; Column 2), the percent identity of the polypeptide in Column 1 to the full length G1435 polypeptide, SEQ ID NO: 1, as determined by a BLASTp analysis with a wordlength (W) of 3, an expectation (E) of 10, and the BLOSUM62 scoring matrix Henikoff & Henikoff (1989) *Proc. Natl. Acad. Sci. USA* 89:10915; Column 3), the amino acid residue coordinates for the respective conserved GARP domains, in amino acid coordinates beginning at the n-terminus, of each of the sequences (Column 4), the conserved GARP domain sequences of the respective polypeptides (Column 5); the SEQ ID NO: of each of the GARP domains (Column 6), and the percentage identity of the conserved GARP domain in Column 5 to the conserved GARP domain, SEQ ID NO: 1995, in the *Arabidopsis* G1435 sequence, SEQ ID NO: 1796 (Column 7; determined by BLASTp analysis as indicated above).

TABLE 4

Conserved domains and potentially valuable morphological traits of G1435 and closely related sequences

| Column 1 Polypeptide SEQ ID NO: | Column 2 Species/ GID No. | Column 3 Percent identity of polypeptide in Column 1 to G1435 (identical residues/ total number of residues compared) | Column 4 GARP domain in amino acid coordinates | Column 5 Conserved GARP domain | Column 6 SEQ ID NO: of GARP domain | Column 7 Percent identity of conserved domain in Column 5 to conserved domain of G1435 |
|---|---|---|---|---|---|---|
| 1796 | At/G1435 | 100% (298/298) | 146-194 | WTPQLHKRFVDVVAH LGIKNAVPKTIMQLM NVEGLTRENVASHLQ KYRL | 1995 | 100% (49/49) |
| 1984 | At/G2741 | 61% (205/331) | 149-197 | WTPQLHKRFVDVVAH LGIKNAVPKTIMQLM NVEGLTRENVASHLQ KYRL | 1996 | 100% (49/49) |
| 1986 | Gm/G4243 | 53% (147/274) | 148-196 | WTPQLHKRFVDVVAH LGIKNAVPKTIMQLM NVEGLTRENVASHLQ KYRL | 1997 | 100% (49/49) |
| 1988 | Gm/G4244 | 56% (141/250) | 149-197 | WTPQLHKRFVDVVAH LGIKNAVPKTIMQLM NVEGLTRENVASHLQ KYRL | 1998 | 100% (49/49) |
| 1994 | Zm/G4240 | 50% (130/257) | 141-189 | WTPQLHKRFVDVVAH LGMKNAVPKTIMQLM NVEGLTRENVASHLQ KYRL | 2001 | 97% (47/49) |
| 1992 | Os/G4241 | 56% (119/212) | 123-171 | WTPQLHKRFVEVVAH LGMKNAVPKTIMQLM NVEGLTRENVASHLQ KYRL | 2000 | 95% (47/49) |
| 1990 | Le/G4245 | 46% (146/317) | 155-203 | WTPQLHKRFIEVVAH LGIKGAVPKTIMQLM NVEGLTRENVAGHLQ KYRL | 1999 | 91% (45/49) |

Species abbreviations for Table 4: At - *Arabidopsis thaliana*; Gm - *Glycine max*; Le - *Lycopersicon esculentum*; Os - *Oryza sativa*; Zm - *Zea mays*.

Production of Transgenic Plants

Modification of Traits

The polynucleotides of the invention are favorably employed to produce transgenic plants with various traits, or characteristics, that have been modified in a desirable manner, e.g., to improve the seed characteristics of a plant. For example, alteration of expression levels or patterns (e.g., spatial or temporal expression patterns) of one or more of the transcription factors (or transcription factor homologues) of the invention, as compared with the levels of the same protein found in a control or a wild type plant, can be used to modify a plant's traits. An illustrative example of trait modification, improved characteristics, by altering expression levels of a particular transcription factor is described further in the Examples and the Sequence Listing.

Antisense and Cosuppression Approaches

In addition to expression of the nucleic acids of the invention as gene replacement or plant phenotype modification nucleic acids, the nucleic acids are also useful for sense and anti-sense suppression of expression, e.g., to down-regulate expression of a nucleic acid of the invention, e.g., as a further mechanism for modulating plant phenotype. That is, the nucleic acids of the invention, or subsequences or anti-sense sequences thereof, can be used to block expression of naturally occurring homologous nucleic acids. A variety of sense and anti-sense technologies are known in the art, e.g., as set forth in Lichtenstein and Nellen (1997) *Antisense Technology: A Practical Approach* IRL Press at Oxford University, Oxford, England. In general, sense or anti-sense sequences are introduced into a cell, where they are optionally amplified, e.g., by transcription. Such sequences include both simple oligonucleotide sequences and catalytic sequences such as ribozymes.

For example, a reduction or elimination of expression (i.e., a "knock-out") of a transcription factor or transcription factor homologue polypeptide in a transgenic plant, e.g., to modify a plant trait, can be obtained by introducing an antisense construct corresponding to the polypeptide of interest as a cDNA. For antisense suppression, the transcription factor or homologue cDNA is arranged in reverse orientation (with respect to the coding sequence) relative to the promoter sequence in the expression vector. The introduced sequence need not be the full length cDNA or gene, and need not be identical to the cDNA or gene found in the plant type to be transformed. Typically, the antisense sequence need only be capable of hybridizing to the target gene or RNA of interest. Thus, where the introduced sequence is of shorter length, a higher degree of homology to the endogenous transcription factor sequence will be needed for effective antisense suppression. While antisense sequences of various lengths can be utilized, preferably, the introduced antisense sequence in the vector will be at least 30 nucleotides in length, and improved antisense suppression will typically be observed as the length of the antisense sequence increases. Preferably, the length of the antisense sequence in the vector will be greater than 100 nucleotides. Transcription of an antisense construct as described results in the production of RNA molecules that are the reverse complement of mRNA molecules transcribed from the endogenous transcription factor gene in the plant cell.

Suppression of endogenous transcription factor gene expression can also be achieved using a ribozyme. Ribozymes are RNA molecules that possess highly specific endoribonuclease activity. The production and use of ribozymes are disclosed in U.S. Pat. No. 4,987,071 and U.S. Pat. No. 5,543,508. Synthetic ribozyme sequences including antisense RNAs can be used to confer RNA cleaving activity on the antisense RNA, such that endogenous mRNA molecules that hybridize to the antisense RNA are cleaved, which in turn leads to an enhanced antisense inhibition of endogenous gene expression.

Vectors in which RNA encoded by a transcription factor or transcription factor homologue cDNA is over-expressed can also be used to obtain co-suppression of a corresponding endogenous gene, e.g., in the manner described in U.S. Pat. No. 5,231,020 to Jorgensen. Such co-suppression (also termed sense suppression) does not require that the entire transcription factor cDNA be introduced into the plant cells, nor does it require that the introduced sequence be exactly identical to the endogenous transcription factor gene of interest. However, as with antisense suppression, the suppressive efficiency will be enhanced as specificity of hybridization is increased, e.g., as the introduced sequence is lengthened, and/or as the sequence similarity between the introduced sequence and the endogenous transcription factor gene is increased.

Vectors expressing an untranslatable form of the transcription factor mRNA, e.g., sequences comprising one or more stop codon, or nonsense mutation) can also be used to suppress expression of an endogenous transcription factor, thereby reducing or eliminating it's activity and modifying one or more traits. Methods for producing such constructs are described in U.S. Pat. No. 5,583,021. Preferably, such constructs are made by introducing a premature stop codon into the transcription factor gene. Alternatively, a plant trait can be modified by gene silencing using double-strand RNA (Sharp (1999) *Genes Dev.* 13: 139-141).

Another method for abolishing the expression of a gene is by insertion mutagenesis using the T-DNA of *Agrobacterium tumefaciens*. After generating the insertion mutants, the mutants can be screened to identify those containing the insertion in a transcription factor or transcription factor homologue gene. Plants containing a single transgene insertion event at the desired gene can be crossed to generate homozygous plants for the mutation (Koncz et al. (1992) *Methods in Arabidopsis Research*, World Scientific).

Alternatively, a plant phenotype can be altered by eliminating an endogenous gene, such as a transcription factor or transcription factor homologue, e.g., by homologous recombination (Kempin et al. (1997) *Nature* 389:802).

A plant trait can also be modified by using the cre-lox system (for example, as described in U.S. Pat. No. 5,658, 772). A plant genome can be modified to include first and second lox sites that are then contacted with a Cre recombinase. If the lox sites are in the same orientation, the intervening DNA sequence between the two sites is excised. If the lox sites are in the opposite orientation, the intervening sequence is inverted.

The polynucleotides and polypeptides of this invention can also be expressed in a plant in the absence of an expression cassette by manipulating the activity or expression level of the endogenous gene by other means. For example, by ectopically expressing a gene by T-DNA activation tagging (Ichikawa et al. (1997) *Nature* 390 698-701; Kakimoto et al. (1996) *Science* 274: 982-985). This method entails transforming a plant with a gene tag containing multiple transcriptional enhancers and once the tag has inserted into the genome, expression of a flanking gene coding sequence becomes deregulated. In another example, the transcriptional machinery in a plant can be modified so as to increase transcription levels of a polynucleotide of the invention (See, e.g., PCT Publications WO 96/06166 and WO 98/53057 which describe the modification of the DNA binding specificity of zinc finger proteins by changing particular amino acids in the DNA binding motif).

The transgenic plant can also include the machinery necessary for expressing or altering the activity of a polypeptide encoded by an endogenous gene, for example by altering the phosphorylation state of the polypeptide to maintain it in an activated state.

Transgenic plants (or plant cells, or plant explants, or plant tissues) incorporating the polynucleotides of the invention and/or expressing the polypeptides of the invention can be produced by a variety of well established techniques as described above. Following construction of a vector, most typically an expression cassette, including a polynucleotide, e.g., encoding a transcription factor or transcription factor homologue, of the invention, standard techniques can be used to introduce the polynucleotide into a plant, a plant cell, a plant explant or a plant tissue of interest. Optionally, the plant cell, explant or tissue can be regenerated to produce a transgenic plant.

The plant can be any higher plant, including gymnosperms, monocotyledonous and dicotyledonous plants. Suitable protocols are available for Leguminosae (alfalfa, soybean, clover, etc.), Umbelliferae (carrot, celery, parsnip), Cruciferae (cabbage, radish, rapeseed, broccoli, etc.), Curcurbitaceae (melons and cucumber), Gramineae (wheat, corn, rice, barley, millet, etc.), Solanaceae (potato, tomato, tobacco, peppers, etc.), and various other crops. See protocols described in Ammirato et al. (1984) *Handbook of Plant Cell Culture— Crop Species*. Macmillan Publ. Co. Shimamoto et al. (1989) *Nature* 338:274-276; Fromm et al. (1990) *Bio/Technology* 8:833-839; and Vasil et al. (1990) *Bio/Technology* 8:429-434.

Transformation and regeneration of both monocotyledonous and dicotyledonous plant cells is now routine, and the selection of the most appropriate transformation technique will be determined by the practitioner. The choice of method will vary with the type of plant to be transformed; those skilled in the art will recognize the suitability of particular methods for given plant types. Suitable methods can include, but are not limited to: electroporation of plant protoplasts; liposome-mediated transformation; polyethylene glycol (PEG) mediated transformation; transformation using viruses; micro-injection of plant cells; micro-projectile bombardment of plant cells; vacuum infiltration; and *Agrobacterium tumeficiens* mediated transformation. Transformation means introducing a nucleotide sequence in a plant in a manner to cause stable or transient expression of the sequence.

Successful examples of the modification of plant characteristics by transformation with cloned sequences which serve to illustrate the current knowledge in this field of technology, and which are herein incorporated by reference, include: U.S. Pat. Nos. 5,571,706; 5,677,175; 5,510,471; 5,750,386; 5,597,945; 5,589,615; 5,750,871; 5,268,526; 5,780,708; 5,538,880; 5,773,269; 5,736,369 and 5,610,042.

Following transformation, plants are preferably selected using a dominant selectable marker incorporated into the transformation vector. Typically, such a marker will confer antibiotic or herbicide resistance on the transformed plants, and selection of transformants can be accomplished by exposing the plants to appropriate concentrations of the antibiotic or herbicide.

After transformed plants are selected and grown to maturity, those plants showing a modified trait are identified. The modified trait can be any of those traits described above. Additionally, to confirm that the modified trait is due to changes in expression levels or activity of the polypeptide or polynucleotide of the invention can be determined by analyzing mRNA expression using Northern blots, RT-PCR or microarrays, or protein expression using immunoblots or Western blots or gel shift assays.

Integrated Systems—Sequence Identity

Additionally, the present invention may be an integrated system, computer or computer readable medium that comprises an instruction set for determining the identity of one or more sequences in a database. In addition, the instruction set can be used to generate or identify sequences that meet any specified criteria. Furthermore, the instruction set may be used to associate or link certain functional benefits, such improved characteristics, with one or more identified sequence.

For example, the instruction set can include, e.g., a sequence comparison or other alignment program, e.g., an available program such as, for example, the Wisconsin Package Version 10.0, such as BLAST, FASTA, PILEUP, FINDPATTERNS or the like (GCG, Madison, Wis.). Public sequence databases such as GenBank, EMBL, Swiss-Prot and PIR or private sequence databases such as PhytoSeq (Incyte Pharmaceuticals, Palo Alto, Calif.) can be searched.

Alignment of sequences for comparison can be conducted by the local homology algorithm of Smith and Waterman (1981) *Adv. Appl. Math.* 2:482, by the homology alignment algorithm of Needleman and Wunsch (1970) *J. Mol. Biol.* 48:443, by the search for similarity method of Pearson and Lipman (1988) *Proc. Natl. Acad. Sci. U.S.A.* 85: 2444, by computerized implementations of these algorithms. After alignment, sequence comparisons between two (or more) polynucleotides or polypeptides are typically performed by comparing sequences of the two sequences over a comparison window to identify and compare local regions of sequence similarity. The comparison window can be a segment of at least about 20 contiguous positions, usually about 50 to about 200, more usually about 100 to about 150 contiguous positions. A description of the method is provided in Ausubel et al., supra.

A variety of methods of determining sequence relationships can be used, including manual alignment and computer assisted sequence alignment and analysis. This later approach is a preferred approach in the present invention, due to the increased throughput afforded by computer assisted methods. As noted above, a variety of computer programs for performing sequence alignment are available, or can be produced by one of skill.

One example algorithm that is suitable for determining percent sequence identity and sequence similarity is the BLAST algorithm, which is described in Altschul et al. *J. Mol. Biol.* 215:403-410 (1990). Software for performing BLAST analyses is publicly available, e.g., through the National Center for Biotechnology Information (http://www.ncbi.nlm.nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) supra).

In addition to calculating percent sequence identity, the BLAST algorithm also performs a statistical analysis of the similarity between two sequences (see, e.g., Karlin & Altschul (1993) *Proc. Natl. Acad. Sci. USA* 90:5873-5787). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence (and, therefore, in this context, homologous) if the smallest sum probability in a comparison of the test nucleic acid to the reference nucleic acid is less than about 0.1, or less than about 0.01, and or even less than about 0.001. An additional example of a useful sequence alignment algorithm is PILEUP. PILEUP creates a multiple sequence alignment from a group of related sequences using progressive, pairwise alignments. The program can align, e.g., up to 300 sequences of a maximum length of 5,000 letters.

The integrated system, or computer typically includes a user input interface allowing a user to selectively view one or more sequence records corresponding to the one or more character strings, as well as an instruction set which aligns the one or more character strings with each other or with an additional character string to identify one or more region of sequence similarity. The system may include a link of one or more character strings with a particular phenotype or gene function. Typically, the system includes a user readable output element which displays an alignment produced by the alignment instruction set.

The methods of this invention can be implemented in a localized or distributed computing environment. In a distributed environment, the methods may implemented on a single computer comprising multiple processors or on a multiplicity of computers. The computers can be linked, e.g. through a common bus, but more preferably the computer(s) are nodes on a network. The network can be a generalized or a dedicated local or wide-area network and, in certain preferred embodiments, the computers may be components of an intra-net or an internet.

Thus, the invention provides methods for identifying a sequence similar or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an inter or intra net) and a query is made against the sequence database using the relevant sequences herein and associated plant phenotypes or gene functions.

Any sequence herein can be entered into the database, before or after querying the database. This provides for both expansion of the database and, if done before the querying step, for insertion of control sequences into the database. The control sequences can be detected by the query to ensure the general integrity of both the database and the query. As noted, the query can be performed using a web browser based interface. For example, the database can be a centralized public database such as those noted herein, and the querying can be done from a remote terminal or computer across an internet or intranet.

EXAMPLES

The following examples are intended to illustrate but not limit the present invention.

Example I

Full Length Gene Identification and Cloning

Putative transcription factor sequences (genomic or ESTs) related to known transcription factors were identified in the *Arabidopsis thaliana* GenBank database using the tblastn sequence analysis program using default parameters and a P-value cutoff threshold of −4 or −5 or lower, depending on the length of the query sequence. Putative transcription factor sequence hits were then screened to identify those containing particular sequence strings. If the sequence hits contained such sequence strings, the sequences were confirmed as transcription factors.

Alternatively, *Arabidopsis thaliana* cDNA libraries derived from different tissues or treatments, or genomic libraries were screened to identify novel members of a transcription family using a low stringency hybridization approach. Probes were synthesized using gene specific primers in a standard PCR reaction (annealing temperature 60° C.) and labeled with $^{32}$P dCTP using the High Prime DNA Labeling Kit (Boehringer Mannheim). Purified radiolabelled probes were added to filters immersed in Church hybridization medium (0.5 M NaPO$_4$ pH 7.0, 7% SDS, 1% w/v bovine serum albumin) and hybridized overnight at 60° C. with shaking. Filters were washed two times for 45 to 60 minutes with 1×SCC, 1% SDS at 60° C.

To identify additional sequence 5' or 3' of a partial cDNA sequence in a cDNA library, 5' and 3' rapid amplification of cDNA ends (RACE) was performed using the Marathon™ cDNA amplification kit (Clontech, Palo Alto, Calif.). Generally, the method entailed first isolating poly(A) mRNA, performing first and second strand cDNA synthesis to generate double stranded cDNA, blunting cDNA ends, followed by ligation of the Marathon™ Adaptor to the cDNA to form a library of adaptor-ligated ds cDNA.

Gene-specific primers were designed to be used along with adaptor specific primers for both 5' and 3' RACE reactions. Nested primers, rather than single primers, were used to increase PCR specificity. Using 5' and 3' RACE reactions, 5' and 3' RACE fragments were obtained, sequenced and cloned. The process can be repeated until 5' and 3' ends of the full-length gene were identified. Then the full-length cDNA was generated by PCR using primers specific to 5' and 3' ends of the gene by end-to-end PCR.

Example II

Construction of Expression Vectors

The sequence was amplified from a genomic or cDNA library using primers specific to sequences upstream and downstream of the coding region. The expression vector was pMEN20 or pMEN65, which are both derived from pMON316 (Sanders et al, (1987) *Nucleic Acids Res.* 15:1543-58) and contain the CaMV 35S promoter to express transgenes. To clone the sequence into the vector, both pMEN20 and the amplified DNA fragment were digested separately with SalI and NotI restriction enzymes at 37° C. for 2 hours. The digestion products were subject to electrophoresis in a 0.8% agarose gel and visualized by ethidium bromide staining. The DNA fragments containing the sequence and the linearized plasmid were excised and purified by using a Qiaquick gel extraction kit (Qiagen, CA). The fragments of interest were ligated at a ratio of 3:1 (vector to insert). Ligation reactions using T4 DNA ligase (New England Biolabs, MA) were carried out at 16° C. for 16 hours. The ligated DNAs were transformed into competent cells of the *E. coli* strain DH5alpha by using the heat shock method. The transformations were plated on LB plates containing 50 mg/l kanamycin (Sigma).

Individual colonies were grown overnight in five milliliters of LB broth containing 50 mg/l kanamycin at 37° C. Plasmid DNA was purified by using Qiaquick Mini Prep kits (Qiagen, CA).

Example III

Transformation of *Agrobacterium* with the Expression Vector

After the plasmid vector containing the gene was constructed, the vector was used to transform *Agrobacterium tumefaciens* cells expressing the gene products. The stock of *Agrobacterium tumefaciens* cells for transformation was made as described by Nagel et al. (1990) *FEMS MicroBiol. Letts.* 67: 325-328. *Agrobacterium* strain ABI was grown in 250 ml LB medium (Sigma) overnight at 28° C. with shaking until an absorbance ($A_{600}$) of 0.5-1.0 was reached. Cells were harvested by centrifugation at 4,000×g for 15 min at 4° C. Cells were then resuspended in 250 µl chilled buffer (1 mM HEPES, pH adjusted to 7.0 with KOH). Cells were centrifuged again as described above and resuspended in 125 µl chilled buffer. Cells were then centrifuged and resuspended two more times in the same HEPES buffer as described above at a volume of 100 µl and 750 µl, respectively. Resuspended cells were then distributed into 40 µl aliquots, quickly frozen in liquid nitrogen, and stored at −80° C.

Agrobacterium cells were transformed with plasmids prepared as described above following the protocol described by Nagel et al. For each DNA construct to be transformed, 50-100 ng DNA (generally resuspended in 10 mM Tris-HCl, 1 mM EDTA, pH 8.0) was mixed with 40 µl of Agrobacterium cells. The DNA/cell mixture was then transferred to a chilled cuvette with a 2 mm electrode gap and subject to a 2.5 kV charge dissipated at 25 µF and 200° F. using a Gene Pulser II apparatus (Bio-Rad). After electroporation, cells were immediately resuspended in 1.0 ml LB and allowed to recover without antibiotic selection for 2-4 hours at 28° C. in a shaking incubator. After recovery, cells were plated onto selective medium of LB broth containing 100 µg/ml spectinomycin (Sigma) and incubated for 24-48 hours at 28° C. Single colonies were then picked and inoculated in fresh medium. The presence of the plasmid construct was verified by PCR amplification and sequence analysis.

Example IV

Transformation of Arabidopsis Plants with Agrobacterium tumefaciens with Expression Vector After transformation of Agrobacterium tumefaciens with plasmid vectors containing the gene, single Agrobacterium colonies were identified, propagated, and used to transform Arabidopsis plants. Briefly, 500 ml cultures of LB medium containing 50 mg/l kanamycin were inoculated with the colonies and grown at 28° C. with shaking for 2 days until an absorbance ($A_{600}$) of >2.0 is reached. Cells were then harvested by centrifugation at 4,000×g for 10 min, and resuspended in infiltration medium (½× Murashige and Skoog salts (Sigma), 1× Gamborg's B-5 vitamins (Sigma), 5.0% (w/v) sucrose (Sigma), 0.044 µM benzylamino purine (Sigma), 200 µl/L Silwet L-77 (Lehle Seeds) until an absorbance ($A_{600}$) of 0.8 was reached.

Prior to transformation, Arabidopsis thaliana seeds (ecotype Columbia) were sown at a density of ~10 plants per 4" pot onto Pro-Mix BX potting medium (Hummert International) covered with fiberglass mesh (18 mm×16 mm). Plants were grown under continuous illumination (50-75 µE/m²/sec) at 22-23° C. with 65-70% relative humidity. After about 4 weeks, primary inflorescence stems (bolts) are cut off to encourage growth of multiple secondary bolts. After flowering of the mature secondary bolts, plants were prepared for transformation by removal of all siliques and opened flowers.

The pots were then immersed upside down in the mixture of Agrobacterium infiltration medium as described above for 30 sec, and placed on their sides to allow draining into a 1'×2' flat surface covered with plastic wrap. After 24 h, the plastic wrap was removed and pots are turned upright. The immersion procedure was repeated one week later, for a total of two immersions per pot. Seeds were then collected from each transformation pot and analyzed following the protocol described below.

Example V

Identification of Arabidopsis Primary Transformants

Seeds collected from the transformation pots were sterilized essentially as follows. Seeds were dispersed into in a solution containing 0.1% (v/v) Triton X-100 (Sigma) and sterile $H_2O$ and washed by shaking the suspension for 20 min. The wash solution was then drained and replaced with fresh wash solution to wash the seeds for 20 min with shaking. After removal of the second wash solution, a solution containing 0.1% (v/v) Triton X-100 and 70% ethanol (Equistar) was added to the seeds and the suspension was shaken for 5 min. After removal of the ethanol/detergent solution, a solution containing 0.1% (v/v) Triton X-100 and 30% (v/v) bleach (Clorox) was added to the seeds, and the suspension was shaken for 10 min. After removal of the bleach/detergent solution, seeds were then washed five times in sterile distilled $H_2O$. The seeds were stored in the last wash water at 4° C. for 2 days in the dark before being plated onto antibiotic selection medium (1× Murashige and Skoog salts (pH adjusted to 5.7 with 1M KOH), 1× Gamborg's B-5 vitamins, 0.9% phytagar (Life Technologies), and 50 mg/l kanamycin). Seeds were germinated under continuous illumination (50-75 µE/m²/sec) at 22-23° C. After 7-10 days of growth under these conditions, kanamycin resistant primary transformants ($T_1$ generation) were visible and obtained. These seedlings were transferred first to fresh selection plates where the seedlings continued to grow for 3-5 more days, and then to soil (Pro-Mix BX potting medium).

Primary transformants were crossed and progeny seeds ($T_2$) collected; kanamycin resistant seedlings were selected and analyzed. The expression levels of the recombinant polynucleotides in the transformants vary from about a 5% expression level increase to a least a 100% expression level increase. Similar observations are made with respect to polypeptide level expression.

Example VI

Identification of Arabidopsis Plants with Transcription Factor Gene Knockouts

The screening of insertion mutagenized Arabidopsis collections for null mutants in a known target gene was essentially as described in Krysan et al (1999) Plant Cell 11:2283-2290. Briefly, gene-specific primers, nested by 5-250 base pairs to each other, were designed from the 5' and 3' regions of a known target gene. Similarly, nested sets of primers were also created specific to each of the T-DNA or transposon ends (the "right" and "left" borders). All possible combinations of gene specific and T-DNA/transposon primers were used to detect by PCR an insertion event within or close to the target gene. The amplified DNA fragments were then sequenced which allows the precise determination of the T-DNA/transposon insertion point relative to the target gene. Insertion events within the coding or intervening sequence of the genes were deconvoluted from a pool comprising a plurality of insertion events to a single unique mutant plant for functional characterization. The method is described in more detail in Yu and Adam, U.S. application Ser. No. 09/177,733 filed Oct. 23, 1998.

Example VII

Identification of Modified Phenotype in Overexpressor or Gene Knockout Plants Experiments were performed to identify those transformants or knockouts that exhibited modified biochemical characteristics. Among the biochemicals that were assayed were insoluble sugars, such as arabinose, fucose, galactose, mannose, rhamnose or xylose or the like; prenyl lipids, such as lutein, β-carotene, xanthophyll-1, xanthophyll-2, chlorophylls A or B, or α-, δ- or γ-tocopherol or the like; fatty acids, such as 16:0 (palmitic acid), 16:1 (palmitoleic acid), 18:0 (stearic acid), 18:1 (oleic acid), 18:2 (linoleic acid), 20:0, 18:3 (linolenic acid), 20:1 (eicosenoic acid), 20:2, 22:1 (erucic acid) or the like; waxes, such as by altering the levels of C29, C31, or C33 alkanes; sterols, such as brassicasterol, campesterol, stigmasterol, sitosterol or stigmastanol or the like, glucosinolates, protein or oil levels Fatty acids were measured using two methods depending on whether the tissue was from leaves or seeds. For leaves, lipids were extracted and esterified with hot methanolic $H_2SO_4$ and partitioned into hexane from methanolic brine. For seed fatty acids, seeds were pulverized and extracted in methanol:heptane:toluene:2,2-dimethoxypropane:$H_2SO_4$ (39:34:20:5:2) for 90 minutes at 80° C. After cooling to room temperature the upper phase, containing the seed fatty acid esters, was subjected to GC analysis. Fatty acid esters from both seed and leaf tissues were analyzed with a Supelco SP-2330 column.

Glucosinolates were purified from seeds or leaves by first heating the tissue at 95° C. for 10 minutes. Preheated ethanol:water (50:50) is and after heating at 95° C. for a further 10 minutes, the extraction solvent is applied to a DEAE Sephadex column which had been previously equilibrated with 0.5 M pyridine acetate. Desulfoglucosinolates were eluted with 300 μl water and analyzed by reverse phase HPLC monitoring at 226 nm.

For wax alkanes, samples were extracted using an identical method as fatty acids and extracts were analyzed on a HP 5890 GC coupled with a 5973 MSD. Samples were chromatographed on a J&W DB35 mass spectrometer (J&W Scientific).

To measure prenyl lipids levels, seeds or leaves were pulverized with 1 to 2% pyrogallol as an antioxidant. For seeds, extracted samples were filtered and a portion removed for tocopherol and carotenoid/chlorophyll analysis by HPLC. The remaining material was saponified for sterol determination. For leaves, an aliquot was removed and diluted with methanol and chlorophyll A, chlorophyll B, and total carotenoids measured by spectrophotometry by determining absorbance at 665.2 nm, 652.5 nm, and 470 nm. An aliquot was removed for tocopherol and carotenoid/chlorophyll composition by HPLC using a Waters μBondapak® C18 column (4.6 mm×150 mm). The remaining methanolic solution was saponified with 10% KOH at 80° C. for one hour. The samples were cooled and diluted with a mixture of methanol and water. A solution of 2% methylene chloride in hexane was mixed in and the samples were centrifuged. The aqueous methanol phase was again re-extracted 2% methylene chloride in hexane and, after centrifugation, the two upper phases were combined and evaporated. 2% methylene chloride in hexane was added to the tubes and the samples were then extracted with one ml of water. The upper phase was removed, dried, and resuspended in 400 μl of 2% methylene chloride in hexane and analyzed by gas chromatography using a 50 m DB-5 ms (0.25 mm ID, 0.25 um phase, J&W Scientific).

Insoluble sugar levels were measured by the method essentially described by Reiter et al. *Plant J.* 12:335-345. This method analyzes the neutral sugar composition of cell wall polymers found in *Arabidopsis* leaves. Soluble sugars were separated from sugar polymers by extracting leaves with hot 70% ethanol. The remaining residue containing the insoluble polysaccharides was then acid hydrolyzed with allose added as an internal standard. Sugar monomers generated by the hydrolysis were then reduced to the corresponding alditols by treatment with $NaBH_4$, then were acetylated to generate the volatile alditol acetates which were then analyzed by GC-FID. Identity of the peaks was determined by comparing the retention times of known sugars converted to the corresponding alditol acetates with the retention times of peaks from wild-type plant extracts. Alditol acetates were analyzed on a Supelco SP-2330 capillary column (30 m×250 um×0.2 um) using a temperature program beginning at 180° C. for 2 minutes followed by an increase to 220° C. in 4 minutes. After holding at 220° C. for 10 minutes, the oven temperature is increased to 240° C. in 2 minutes and held at this temperature for 10 minutes and brought back to room temperature.

To identify plants with alterations in total seed oil or protein content, 150 mg of seeds from T2 progeny plants were subjected to analysis by Near Infrared Reflectance (NIR) using a Foss NirSystems Model 6500 with a spinning cup transport system.

Experiments were performed to identify those transformants or knockouts that exhibited an improved pathogen tolerance. For such studies, the transformants were exposed to biotropic fungal pathogens, such as *Erysiphe orontii*, and necrotropic fungal pathogens, such as *Fusarium oxysporum*. *Fusarium oxysporum* isolates cause vascular wilts and damping off of various annual vegetables, perennials and weeds (Mauch-Mani and Slusarenko (1994) *Mol. Plant-Microbe Interact.* 7: 378-383). For *Fusarium oxysporum* experiments, plants grown on Petri dishes were sprayed with a fresh spore suspension of *F. oxysporum*. The spore suspension was prepared as follows: A plug of fungal hyphae from a plate culture was placed on a fresh potato dextrose agar plate and allowed to spread for one week. 5 ml sterile water was then added to the plate, swirled, and pipetted into 50 ml Armstrong *Fusarium* medium. Spores were grown overnight in *Fusarium* medium and then sprayed onto plants using a Preval paint sprayer. Plant tissue was harvested and frozen in liquid nitrogen 48 hours post infection.

*Erysiphe orontii* is a causal agent of powdery mildew. For *Erysiphe orontii* experiments, plants were grown approximately 4 weeks in a greenhouse under 12 hour light (20 C, ~30% relative humidity (rh)). Individual leaves were infected with *E. orontii* spores from infected plants using a camel's hair brush, and the plants were transferred to a Percival growth chamber (20 C, 80% rh.). Plant tissue was harvested and frozen in liquid nitrogen 7 days post infection.

*Botrytis cinerea* is a necrotrophic pathogen. *Botrytis cinerea* was grown on potato dextrose agar in the light. A spore culture was made by spreading 10 ml of sterile water on the fungus plate, swirling and transferring spores to 10 ml of sterile water. The spore inoculum (approx. 105 spores/ml) was used to spray 10 day-old seedlings grown under sterile conditions on MS (-sucrose) media. Symptoms were evaluated every day up to approximately 1 week.

Infection with bacterial pathogens *Pseudomonas syringae* pv maculicola strain 4326 and pv maculicola strain 4326 was performed by hand inoculation at two doses. Administration of two inoculation doses allows the differentiation between plants with enhanced susceptibility and plants with enhanced resistance to the pathogen. Plants were grown for 3 weeks in the greenhouse, then transferred to the growth chamber for the remainder of their growth. Psm ES4326 was hand inoculated with 1 ml syringe on 3 fully-expanded leaves per plant (4½ wk old), using at least 9 plants per overexpressing line at two inoculation doses, OD=0.005 and OD=0.0005. Disease scoring occurred at day 3 post-inoculation with pictures of the plants and leaves taken in parallel In some instances, expression patterns of the pathogen induced genes (such as defense genes) were monitored by microarray experiments. cDNAs were generated by PCR and resuspended at a final concentration of ~100 ng/μl in 3×SSC or 150 mM Na-phosphate (Eisen and Brown (1999) *Meth. in Enzymol.* 303:179-205). The cDNAs were spotted on microscope glass slides coated with polylysine. The prepared cDNAs were aliquoted into 384 well plates and spotted on the slides using an x-y-z gantry (OmniGrid) purchased from GeneMachines (Menlo Park, Calif.) outfitted with quill type pins purchased from Telechem International (Sunnyvale, Calif.). After spotting, the arrays were cured for a minimum of one week at room temperature, rehydrated and blocked following the protocol recommended by Eisen and Brown (1999).

Sample total RNA (10 μg) samples were labeled using fluorescent Cy3 and Cy5 dyes. Labeled samples were resuspended in 4×SSC/0.03% SDS/4 μg salmon sperm DNA/2 μg tRNA/50 mM Na-pyrophosphate, heated for 95° C. for 2.5 minutes, spun down and placed on the array. The array was then covered with a glass coverslip and placed in a sealed chamber. The chamber was then kept in a water bath at 62° C. overnight. The arrays were washed as described in Eisen and Brown (1999) and scanned on a General Scanning ScanArray™ 3000 laser scanner. The resulting files are subsequently quantified using Imagene a software purchased from BioDiscovery (Los Angeles, Calif.).

Measurement of Photosynthesis.

Photosynthesis was measured using a LICOR LI-6400 (Li-Cor® Biosciences, Lincoln, Nebr.). The LI-6400 used infrared gas analyzers to measure carbon dioxide to generate a photosynthesis measurement. It was based upon the difference of the $CO_2$ reference (the amount put into the chamber) and the $CO_2$ sample (the amount that leaves the chamber). Since photosynthesis is the process of converting $CO_2$ to carbohydrates, we expected to see a decrease in the amount of $CO_2$ sample. From this difference, a photosynthesis rate could be generated. In some cases, respiration may occur and an increase in $CO_2$ detected. To perform measurements, the LI-6400 as set-up and calibrated as per LI-6400 standard directions. Photosynthesis was measured in the youngest, most fully expanded leaf at 300 and 1000 ppm $CO_2$ using a metal halide light source. This light source provided about 700 $\mu E\ m^{-2}\ s^{-1}$.

Environmental Stress Tolerance.

Experiments were performed to identify those transformants or knockouts that exhibited an improved environmental stress tolerance. For such studies, the transformants were exposed to a variety of environmental stresses. Plants were exposed to chilling stress (6 hour exposure to 4°-8° C.), heat stress (6 hour exposure to 32°-37° C.), high salt stress (germination in 150 mM NaCl or a 6 hour exposure of plants to 200 mM NaCl), drought stress (withholding of water for 168 hours), hyperosmotic stress (for example, germination in 9.4% sucrose or a 6 hour exposure to 3 M mannitol), desiccation, or nutrient limitation (nitrogen, phosphate, and potassium) (Nitrogen: all components of MS medium remained constant except N was reduced to 20 mg/L of $NH_4NO_3$, or Phosphate: All components of MS medium except $KH_2PO_4$, which was replaced by $K_2SO_4$, Potassium: All components of MS medium except removal of $KNO_3$ and $KH_2PO_4$, which were replaced by $NaH_4PO_4$). For analysis of ability to tolerate desiccation (a plate-based water deprivation assay), seedlings were grown for 14 days on MS+Vitamins+1% sucrose at 22° C. Plates were opened in the sterile hood for 3 hr for hardening and then seedlings were removed from the media and let dry for two hours in the hood. After this time the plants were transferred back to plates and incubated at 22° C. for recovery. The plants were then evaluated after five days.

Soil-based drought assays. Seeds were sterilized by a 2 minute ethanol treatment followed by 20 minutes in 30% bleach/0.01% Tween and five washes in distilled water. Seeds were sown to MS agar in 0.1% agarose and stratified for three days at 4° C., before transfer to growth cabinets with a temperature of 22° C. After seven days of growth on selection plates, seedlings were transplanted to 3.5 inch diameter clay pots containing 80 g of a 50:50 mix of vermiculite:perlite topped with 80 g of ProMix. Typically, each pot contains 14 seedlings, and plants of the transgenic line being tested were in separate pots to the wild-type controls. Pots containing the transgenic line versus control pots were interspersed in the growth room, maintained under 24-hour light conditions (18-23° C., and 90-100 $\mu E\ m^{-2}\ s^{-1}$) and watered for a period of 14 days. Water was then withheld and pots were placed on absorbent paper for a period of 8-10 days to apply a drought treatment. After this period, a visual qualitative "drought score" from 0-6 was assigned to record the extent of visible drought stress symptoms. A score of "6" corresponded to no visible symptoms whereas a score of "0" corresponded to extreme wilting and the leaves having a "crispy" texture. At the end of the drought period, pots were re-watered and scored after 5-6 days; the number of surviving plants in each pot was counted, and the proportion of the total plants in the pot that survived was calculated.

In a given experiment, we typically compared 6 or more pots of a transgenic line with 6 or more pots of the appropriate control. The mean drought score and mean proportion of plants surviving (survival rate) were calculated for both the transgenic line and the wild-type pots. In each case a p-value* was calculated, which indicated the significance of the difference between the two mean values. The results for each transgenic line across each planting for a particular project were then presented in a results table.

For the assays where control and experimental plants were in separate pots, survival was analyzed with a logistic regression to account for the fact that the random variable is a proportion between 0 and 1. The reported p-value was the significance of the experimental proportion was to the control, based upon regressing the logit-transformed data.

Drought score, being an ordered factor with no real numeric meaning, is analyzed with a non-parametric test between the experimental and control groups. The p-value was calculated with a Mann-Whitney rank-sum test.

Experiments were performed to identify those transformants or knockouts that exhibited a modified structure and development characteristics. For such studies, the transformants were observed by eye to identify novel structural or developmental characteristics associated with the ectopic expression of the polynucleotides or polypeptides of the invention.

Experiments were performed to identify those transformants or knockouts that exhibited modified sugar-sensing. For such studies, seeds from transformants were germinated on media containing 5% glucose or 9.4% sucrose which normally partially restrict hypocotyl elongation. Plants with altered sugar sensing may have either longer or shorter hypocotyls than normal plants when grown on this media. Additionally, other plant traits may be varied such as root mass.

Flowering time was measured by the number of rosette leaves present when a visible inflorescence of approximately 3 cm is apparent Rosette and total leaf number on the progeny stem are tightly correlated with the timing of flowering (Koornneef et al (1991) *Mol. Gen. Genet* 229:57-66. The vernalization response was measured. For vernalization treatments, seeds were sown to MS agar plates, sealed with micropore tape, and placed in a 4° C. cold room with low light levels for 6-8 weeks. The plates were then transferred to the growth rooms alongside plates containing freshly sown non-vernalized controls. Rosette leaves were counted when a visible inflorescence of approximately 3 cm was apparent.

Table 5 shows exemplary modified phenotypes observed for particular overexpressor or knockout plants. Modified phenotypes observed for particular overexpressor or knockout plants were provided in Appendix A in U.S. priority application Ser. No. 09/713,994, filed Nov. 16, 2000 (Appendix A is herein incorporated by reference in its entirety). For a particular overexpressor that shows a less beneficial characteristic, it may be more useful to select a plant with a decreased expression of the particular transcription factor. For a particular knockout that shows a less beneficial characteristic, it may be more useful to select a plant with an increased expression of the particular transcription factor.

Example VIII

Identification of Homologous Sequences

Homologous sequences from *Arabidopsis* and plant species other than *Arabidopsis* were identified using database sequence search tools, such as the Basic Local Alignment Search Tool (BLAST) (Altschul et al. (1990) *J. Mol. Biol.* 215:403-410; and Altschul et al. (1997) *Nucl. Acid Res.* 25: 3389-3402). The tblastx sequence analysis programs were employed using the BLOSUM-62 scoring matrix (Henikoff, S. and Henikoff, J. G. (1992) *Proc. Natl. Acad. Sci. USA* 89: 10915-10919).

Identified *Arabidopsis* homologous sequences are provided in Tables 4 and 5 and included in the Sequence Listing.

The percent sequence identity among these sequences is as low as 46% sequence identity. Additionally, the entire NCBI GenBank database was filtered for sequences from all plants except *Arabidopsis thaliana* by selecting all entries in the NCBI GenBank database associated with NCBI taxonomic ID 33090 (Viridiplantae; all plants) and excluding entries associated with taxonomic ID 3701 (*Arabidopsis thaliana*). These sequences were compared to sequences representing genes of SEQ IDs Nos. 1-54 on Sep. 26, 2000 using the Washington University TBLASTX algorithm (version 2.0a19 MP). For each gene of SEQ IDs Nos. 1-54, individual comparisons were ordered by probability score (P-value), where the score reflects the probability that a particular alignment occurred by chance. For example, a score of 3.6e-40 is $3.6 \times 10^{-40}$. In addition to P-values, comparisons were also scored by percentage identity. Percentage identity reflects the degree to which two segments of DNA or protein are identical over a particular length.

Example IX

Trait summary for Transgenic Plants Overexpressing Sequences of the Invention

Appendix A, filed with priority U.S. patent application Ser. No. 09/713,994 on Nov. 16, 2000, provides traits observed when plants were modified to alter the expression of additional polynucleotide and polypeptide sequences.

The entire contents of Appendix A filed with priority U.S. patent application Ser. No. 09/713,994 are hereby incorporated by reference.

Table 5, below, provides a summary of the traits associated with prior filed Appendix A and the sequences of the invention. Each of the traits listed in Table 5 was observed to be modified in transgenic plants when the expression levels of each of these exemplary sequences were altered by overexpression of suppression. Table 5 lists the Gene IDentifier (GID) of each sequence, the SEQ ID NO: of the polynucleotide corresponding to the GID number, whether the sequence encoded by the respective GID was overexpressed or knocked out in plants, and the trait category and experimental observation made when the expression level of the respective GID was so altered.

TABLE 5

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G4 | 111 | 112 | OE | Disease resistance | Increased resistance to *Botrytis* |
| G5 | 115 | 116 | OE | Plant size | Small plant |
| G6 | 119 | 120 | | | |
| G7 | 123 | 124 | | | |
| G9 | 48 | 128 | OE | Root morphology | Increased root mass |
| | | | OE | Salt tolerance | Greater tolerance to 150 mM NaCl in a germination assay |
| | | | OE | Sugar sensing/ sucrose tolerance | More tolerant to glucose; greater germination and growth on 5% glucose medium |
| | | | OE | Hormone sensitivity | Less sensitive to ABA; seedlings were larger and greener in 0.5 µM ABA in a germination assay |
| | | | OE | Cold tolerance | More tolerant to cold; seedlings had less anthocyanin during growth in 8° C. |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G14 | 130 | 131 | | | |
| G19 | 3 | 135 | OE | Disease resistance | Increased resistance to *Erysiphe* |
| | | | OE | Hormon sensitivity | Repressed by methyl jasmonate and induced by ACC |
| G20 | 138 | 139 | OE | Seed sterols | Increase in campesterol |
| G22 | 19 | 143 | OE | Salt tolerance | Greater tolerance to 150 mM NaCl in a germination assay |
| G23 | 146 | 147 | | | |
| G25 | 150 | 151 | OE | Trichome | Fewer trichomes at seedling stage |
| | | | OE | *Fusarium* | Expression induced by *Fusarium* infection |
| G26 | 60 | 155 | OE | Sugar sensing/ sucrose tolerance | Decreased germination and growth on 5% glucose medium |
| G27 | 105 | 159 | OE | Plant size | Abnormal development, small |
| | | | OE | Altered C/N sensing | Increased sensitivity to media with low nitrogen or lacking nitrogen source |
| G28 | 5 | 163 | OE | Disease resistance | Increased resistance to *Botrytis* |
| | | | OE | Disease resistance | Increased resistance to *Erysiphe* |
| | | | OE | Disease resistance | Increased resistance to *Sclerotinia* |
| G29 | 166 | 167 | | | |
| G30 | 170 | 171 | OE | Leaf morphology | Glossy green leaves |
| | | | OE | Light response | Increased shade tolerance; lack of shade avoidance phenotype |
| G35 | 174 | 175 | | | |
| G36 | 178 | 179 | | | |
| G38 | 61 | 183 | OE | Sugar sensing/ sucrose tolerance | Reduced germination on 5% glucose medium |
| G39 | 186 | 187 | | | |
| G43 | 62 | 191 | OE | Sugar sensing/ sucrose tolerance | Decreased germination and growth on 5% glucose medium |
| G44 | 194 | 195 | | | |
| G142 | 198 | 199 | OE | Flowering time | Early flowering |
| G148 | 202 | 203 | | | |
| G152 | 206 | 207 | | | |
| G157 | 210 | 211 | OE | Flowering time | Modest overexpression triggers early flowering; greater overexpression delays flowering |
| G161 | 214 | 215 | OE | Altered C/N sensing | Increased sensitivity to media with low nitrogen or lacking nitrogen source |
| G164 | 218 | 219 | | | |
| G177 | 222 | 223 | | | |
| G178 | 226 | 227 | | | |
| G180 | 100 | 231 | OE | Seed oil content | Decreased seed oil |
| | | | OE | Flowering time | Early flowering |
| G187 | 56 | 235 | OE | Morphology | Long, thin cotyledons at seedling stage; several flower abnormalities including strap-like, sepaloid petals |
| G188 | 1 | 239 | KO | Salt and hyperosmotic stress | More tolerant to salt and/or osmotic stress: better germination in 150 mM NaCl, 300 mM mannitol, 9.4% sucrose or 5% glucose |
| | | | KO | Disease resistance | Increased susceptibility to *Fusarium* |
| G190 | 242 | 243 | | | |
| G192 | 91 | 247 | OE | Seed oil content | Decreased seed oil content |
| | | | OE | Flowering time | Late flowering |
| G194 | 250 | 251 | OE | Plant size | Small plant |
| | | | OE | Water deprivation tolerance | More tolerant to desiccation |
| G197 | 254 | 255 | OE | Seed oil content | Increased seed oil |
| | | | OE | Seed protein content | Decreased seed protein |
| G198 | 258 | 259 | OE | Salt tolerance | More tolerant to salt; seedlings were larger and greener in a germination assay on 150 mM NaCl |
| G200 | 262 | 263 | KO | Altered C/N sensing | Increased sensitivity to media with low nitrogen or lacking nitrogen source |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G201 | 266 | 267 | OE | Seed protein content | Increased seed protein content |
|  |  |  | OE | Seed oil content | Decreased seed oil content |
| G202 | 270 | 271 | OE | Seed protein content | Decreased seed protein content |
|  |  |  | OE | Seed oil content | Increased seed oil content |
| G203 | 274 | 275 |  |  |  |
| G204 | 279 |  |  |  |  |
| G206 | 282 | 280 | OE | Seed size | Large seeds |
| G207 | 63 | 284 | OE | Sugar sensing/ glucose tolerance | Decreased germination on 5% glucose medium |
|  |  |  | KO | Disease resistance | Increased susceptibility to *Botrytis* |
|  |  |  | OE | Disease resistance | Increased resistance to *Erysiphe* |
| G208 | 102 | 288 | OE | Flowering time | Early flowering |
| G209 | 291 | 292 |  |  |  |
| G210 | 295 | 296 |  |  |  |
| G212 | 301 | 299 | OE | Altered trichome initiation and number | Partially to fully glabrous on adaxial surface of leaves |
| G214 | 35 | 303 | OE | Leaf fatty acids | Increased leaf fatty acids |
|  |  |  | OE | Leaf prenyl lipids | Increased leaf chlorophyll and carotenoids |
|  |  |  | OE | Flowering time | Late flowering |
|  |  |  | OE | Seed prenyl lipids | Increased seed lutein |
| G215 | 308 | 306 |  |  |  |
| G216 | 311 | 309 |  |  |  |
| G217 | 312 | 313 | OE | Seed fatty acids | Increase in 20:2 fatty acid in seeds |
| G219 | 316 | 317 |  |  |  |
| G220 | 320 | 321 |  |  |  |
| G222 | 324 | 325 | OE | Seed oil content | Decreased seed oil content |
|  |  |  | OE | Seed protein content | Increased seed protein content |
| G225 | 20 | 329 | OE | Root | Increased root hairs |
|  |  |  | OE | Trichome | Glabrous, lack of trichomes |
|  |  |  | OE | C/N sensing | Greater growth and/or vigor on media with low nitrogen or lacking nitrogen source |
|  |  |  | OE | Nutrient uptake | Increased tolerance to nitrogen-limited medium |
| G226 | 21 | 333 | OE | Nutrient uptake | Increased tolerance to nitrogen-limited medium |
|  |  |  | OE | Seed protein content | Increased seed protein |
|  |  |  | OE | Root | Increased root hairs |
|  |  |  | OE | Trichome | Glabrous, lack of trichomes |
|  |  |  | OE | Sodium chloride | More tolerant to salt; seedlings were larger and greener in a germination assay on 150 mM NaCl |
|  |  |  | OE | Altered C/N sensing | Greater growth and/or vigor on media with low nitrogen or lacking nitrogen source |
| G228 | 336 | 337 |  |  |  |
| G229 | 36 | 341 | OE | Seed protein content | Decreased seed protein |
|  |  |  | OE | Seed oil content | Increased seed oil |
|  |  |  | OE | Other biochemistry | Up-regulation of genes involved in secondary metabolism |
| G231 | 74 | 345 | OE | Leaf fatty acids | Increased leaf unsaturated fatty acids |
|  |  |  | OE | Seed protein content | Decreased seed protein content |
|  |  |  | OE | Seed oil content | Increased seed oil content |
| G232 | 348 | 349 |  |  |  |
| G233 | 37 | 353 | OE | Disease resistance | Increased resistance to *Botrytis* |
|  |  |  | OE | Disease resistance | Increased resistance to *Erysiphe* |
| G234 | 92 | 357 | OE | Flowering time | Late flowering |
|  |  |  | OE | Altered C/N sensing | Greater growth and/or vigor on media with low nitrogen or lacking nitrogen source |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G237 | 7 | 361 | OE | Leaf biochemistry | Increased leaf insoluble sugars |
| | | | OE | Disease resistance | Increased resistance to *Erysiphe* |
| | | | OE | Altered C/N sensing | Greater growth and/or vigor on media with low nitrogen or lacking nitrogen source |
| G239 | 364 | 365 | OE | Expression/ABA treatment | Expression induced by 0.5 μM ABA |
| | | | OE | Expression from drought | Expression induced by drought |
| | | | OE | Expression/heat treatment | Expression induced by 32° C. |
| | | | OE | Expression/hyperosmotic stress | Expression induced by hyperosmotic stress |
| G241 | 368 | 369 | OE | Seed oil content | Decreased seed oil |
| | | | KO | Seed protein content | Altered seed protein content |
| | | | OE | Sugar sensing/ glucose tolerance | Decreased germination and growth on 5% glucose medium |
| G242 | 372 | 373 | OE | Leaf insoluble sugars | Increased arabinose |
| G245 | 376 | 377 | | | |
| G249 | 380 | 381 | OE | Flowering time | Late flowering |
| | | | OE | Time to senescence | Delayed senescence |
| G251 | 384 | 385 | | | |
| G252 | 388 | 389 | | | |
| G254 | 64 | 393 | OE | Sugar sensing/ glucose tolerance | Decreased germination and growth on 5% glucose medium |
| G256 | 22 | 397 | OE | Cold tolerance | More tolerant to cold; increased seedling vigor and root growth at 8° C. in germination and growth assays |
| G260 | 400 | 401 | | | |
| G261 | 4 | 404 | OE | Disease resistance | Increased susceptibility to *Botrytis* |
| G262 | 407 | 406 | | | |
| G263 | 65 | 409 | OE | Sugar sensing/ glucose tolerance | Decreased root growth on 9.4% sucrose medium |
| | | | OE | Tissue-specific expression | Root specific expression |
| G271 | 412 | 413 | | | |
| G273 | 415 | 416 | | | |
| G274 | 75 | 419 | OE | Leaf insoluble sugars | Increased leaf arabinose |
| G279 | 421 | 422 | | | |
| G285 | 424 | 425 | | | |
| G291 | 427 | 428 | OE | Seed oil content | Increased seed oil content |
| G306 | 430 | 431 | OE | Leaf insoluble sugars | Altered leaf insoluble sugars: increased galactose, decreased arabinose, mannose, rhamnose and xylose |
| G307 | 76 | 435 | OE | Sugar sensing/ glucose tolerance | No germination on 5% glucose medium |
| G308 | 66 | 439 | | | |
| G313 | 442 | 443 | | | |
| G315 | 446 | 447 | | | |
| G321 | 450 | 451 | | | |
| G322 | 453 | 454 | | | |
| G326 | 457 | 458 | OE | Altered C/N sensing | Increased sensitivity to media with low nitrogen or lacking nitrogen source |
| G328 | 461 | 462 | | | |
| G329 | 464 | 465 | | | |
| G330 | 467 | 468 | OE | Cell wall composition | Xylose and rhamnose levels were elevated |
| G335 | 473 | 471 | | | |
| G343 | 474 | 475 | OE | Glyphosate resistance | Increased glyphosate resistance |
| G345 | 477 | 478 | | | |
| G346 | 77 | 482 | OE | Leaf fatty acids | Significant increase in 18:2 leaf fatty acid level |
| | | | OE | Seed oil content | Decreased seed oil |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G355 | 484 | 485 | | | |
| G357 | 488 | 489 | OE | Morphology and development | Most transformants died by the flowering stage; potential herbicide target |
| G361 | 93 | 493 | OE | Flowering time | Late flowering |
| G363 | 496 | 497 | | | |
| G364 | 500 | 501 | OE | Morphology and development | Most transformants died by the flowering stage; potential herbicide target |
| G368 | 504 | 505 | | | |
| G371 | 508 | 509 | OE | Disease resistance | Increased susceptibility to *Botrytis* |
| G376 | 511 | 512 | | | |
| G378 | 16 | 515 | OE | Disease resistance | Increased resistance to *Erysiphe* |
| G384 | 518 | 519 | OE | Altered C/N sensing | Increased sensitivity to media with low nitrogen or lacking nitrogen source |
| G385 | 521 | 522 | OE | Plant size | Small plant |
| | | | OE | Inflorescence | Short inflorescence stems |
| | | | OE | Leaf morphology | Dark green plant |
| G388 | 525 | 526 | | | |
| G389 | 529 | 530 | | | |
| G390 | 533 | 534 | OE | Flowering time | Early flowering |
| | | | OE | Plant morphology | Abnormal, disorganized phyllotaxy; exhibited stem bifurcations in which shoot meristems split to form two or three separate shoots |
| G391 | 537 | 538 | OE | Altered architecture | Altered shoot development; T1 plants were dark green with short bolts, small leaves and short siliques |
| G393 | 541 | 542 | | | |
| G394 | 33 | 546 | OE | Cold tolerance | More sensitive to 8° C.; plants became chlorotic and leaves senesced prematurely |
| G395 | 549 | 550 | | | |
| G396 | 552 | 553 | | | |
| G397 | 556 | 557 | | | |
| G398 | 560 | 561 | | | |
| G399 | 564 | 565 | | | |
| G400 | 567 | 568 | | | |
| G404 | 570 | 571 | | | |
| G409 | 8 | 574 | OE | Disease resistance | Increased resistance to *Erysiphe* |
| G411 | 576 | 577 | | | |
| G412 | 580 | 581 | | | |
| G414 | 584 | 585 | | | |
| G418 | 9 | 588 | OE | Disease resistance | Increased resistance to *Pseudomonas* |
| | | | OE | Seed protein content | Decreased seed protein content |
| G419 | 23 | 591 | OE | Low nutrient tolerance | Increased tolerance to potassium-free medium |
| G425 | 593 | 594 | OE | Disease resistance | Increased resistance to *Pseudomonas* |
| G426 | 596 | 597 | | | |
| G428 | 49 | 601 | OE | Leaf insoluble sugars | Increased leaf insoluble sugars |
| | | | OE | Leaf morphology | Severe lobing of leaves conferring a parsley-like shape |
| G431 | 55 | 605 | OE | Developmental defects | Extremely deleterious or lethal |
| G432 | 608 | 609 | | | |
| G435 | 612 | 613 | OE | Leaf insoluble sugars | Increased leaf insoluble sugars |
| G438 | 52 | 616 | KO | Altered architecture | Reduced branching |
| | | | KO | Stem lignification | Reduced lignin |
| | | | OE | Leaf morphology | Increased leaf size; larger, flatter leaves |
| | | | OE | Leaf morphology | Altered leaf shape; broad flat leaves |
| G439 | 619 | 620 | | | |
| G440 | 623 | 624 | OE | Disease resistance | Increased resistance to *Erysiphe* |
| G441 | 627 | 628 | | | |
| G442 | 631 | 632 | | | |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G443 | 635 | 636 | | | |
| G444 | 639 | 640 | | | |
| G448 | 643 | 644 | | | |
| G449 | 647 | 648 | | | |
| G451 | 651 | 652 | | | |
| G452 | 655 | 656 | | | |
| G455 | 659 | 660 | | | |
| G456 | 663 | 664 | OE | Seed protein content | Decreased seed protein |
| | | | OE | Seed oil content | Increased seed oil |
| G459 | 666 | 667 | | | |
| G461 | 670 | 671 | | | |
| G462 | 673 | 674 | | | |
| G463 | 677 | 678 | | | |
| G464 | 24 | 682 | OE | Seed oil content | Increased seed oil |
| | | | OE | Heat tolerance | More tolerance to heat; seedlings were larger and greener in germination and growth assays at 32° C. |
| | | | OE | Leaf morphology | Altered leaf shape |
| | | | OE | Seed protein content | Decreased seed protein content |
| G466 | 685 | 686 | | | |
| G467 | 688 | 689 | | | |
| G470 | 57 | 692 | OE | Fertility | Short stamen filaments; pollen produced, but not deposited on the stigma |
| G474 | 695 | 696 | | | |
| G475 | 699 | 700 | OE | Flowering time | Early flowering |
| G481 | 703 | 704 | OE | Hyperosmotic stress | More tolerant to mannitol; greater germination and growth on 300 mM mannitol medium |
| | | | OE | Hormone sensitivity | Less sensitive to ABA; seedlings were larger and greener in 0.5 µM ABA in a germination assay |
| | | | OE | Sugar sensing/sucrose tolerance | More tolerant to sucrose; better germination on 9.4% sucrose medium |
| | | | OE | Heat tolerance | More tolerance to heat; seedlings were larger and greener in germination and growth assays at 32° C. |
| | | | OE | Water deprivation tolerance | More tolerant to desiccation and drought |
| G482 | 25 | 708 | OE | Salt tolerance | More tolerant to salt; seedlings were larger and greener in a germination assay on 150 mM NaCl |
| | | | OE | Hyperosmotic stress | More tolerant to mannitol; greater germination and growth on 300 mM mannitol medium |
| | | | OE | Heat tolerance | More tolerance to heat; seedlings were larger and greener in germination and growth assays at 32° C. |
| | | | OE | Water deprivation tolerance | Increased survival and recovery from drought |
| G483 | 711 | 712 | OE | Water deprivation tolerance | Better recovery from drought |
| G484 | 714 | 715 | KO | Altered seed glucosinolates | Altered glucosinolate profile |
| | | | OE | Water deprivation tolerance | More tolerant to desiccation |
| G485 | 718 | 719 | OE | Flowering time | Early flowering |
| | | | KO | Flowering time | Late flowering |
| | | | OE | Water deprivation tolerance | Increased survival and recovery from drought |
| | | | OE | Salt tolerance | More tolerant to salt; seedlings were larger and greener in a germination assay on 150 mM NaCl |
| | | | OE | Cold tolerance | Greater tolerance to cold; in 8° C. in germination and growth assays; seedlings were larger and greener |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| | | | | | during germination and larger during growth |
| | | | OE | Hormone sensitivity | Less sensitive to ABA; seedlings were larger and greener in 0.5 μM ABA in a germination assay |
| | | | OE | Sugar sensing/sucrose tolerance | More tolerant to sucrose; better germination on 9.4% sucrose medium |
| G486 | 94 | 723 | OE | Flowering time | Late flowering |
| | | | OE | Altered C/N sensing | Greater growth and/or vigor on media with low nitrogen or lacking nitrogen source |
| G489 | 34 | 727 | OE | Hyperosmotic stress | More tolerant to mannitol; greater germination and growth on 300 mM mannitol medium |
| | | | OE | Cold tolerance | Greater tolerance to cold; in 8° C. in germination and growth assays; seedlings were larger, greened and had less anthocyanin during germination and growth |
| | | | OE | Water deprivation tolerance | More tolerant to desiccation and drought |
| G501 | 730 | 731 | | | |
| G502 | 26 | 734 | KO | Hyperosmotic stress | Increased sensitivity to 5% glucose or 150 mM NaCl |
| G503 | 737 | 738 | | | |
| G505 | 743 | 741 | OE | Altered C/N sensing | Greater sensitivity to media with low nitrogen or lacking nitrogen source |
| G508 | 744 | 745 | | | |
| G509 | 748 | 749 | KO | Seed oil content | Increased seed oil content |
| | | | KO | Seed protein content | Decreased seed protein content |
| | | | OE | Seed glucosinolates | Increased M39489 and M39497 |
| G511 | 751 | 752 | | | |
| G513 | 755 | 756 | | | |
| G514 | 759 | 760 | | | |
| G516 | 764 | 762 | OE | Hyperosmotic stress | More tolerant to mannitol; greater germination and growth on 300 mM mannitol medium |
| | | | OE | Cold tolerance | Increased tolerance to cold; in an 8° C. growth assay; seedlings had less anthocyanin |
| | | | OE | Seed morphology | Seeds of one line larger |
| | | | OE | Plant size | Seedlings of several lines larger |
| G523 | 765 | 766 | | | |
| G524 | 769 | 770 | | | |
| G525 | 11 | 774 | OE | Disease resistance | Increased tolerance to *Pseudomonas* |
| | | | OE | Leaf insoluble sugars | Increased leaf insoluble sugars |
| G526 | 27 | 778 | OE | Tolerance to hyperosmotic stress | Increased sensitivity to 300 mM mannitol or 10% polyethylene glycol |
| G528 | 781 | 782 | | | |
| G529 | 785 | 786 | | | |
| G531 | 788 | 789 | | | |
| G532 | 792 | 793 | | | |
| G533 | 796 | 797 | | | |
| G535 | 800 | 801 | | | |
| G536 | 67 | 805 | OE | Sugar sensing/ glucose tolerance | Decreased germination and growth on 5% glucose medium |
| G560 | 838 | 839 | | | |
| G561 | 28 | 843 | OE | Seed oil content | Increased seed oil content |
| | | | OE | Nutrient uptake | Increased tolerance to potassium-free medium |
| G562 | 97 | 847 | OE | Flowering time | Late flowering |
| G563 | 850 | 851 | | | |
| G564 | 854 | 855 | | | |
| G566 | 858 | 859 | | | |
| G569 | 17 | 863 | OE | Defense gene expression | Several genes repressed by G569 overexpression, including PR-1, |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| | | | | | MtN21 (upregulated by *Erysiphe*), PAR-1b (inducible by sucrose and salicylic acid), drought-induced protein Dr4, WAK 1 (upregulated by *Erysiphe*), antifungal protein, a glycine rich protein, polygalacturonase, putative β-expansin, flavonol synthase and pathogen-inducible protein CXc750. 12-oxo-phytodienoate 10,11-reductase (octadecanoid biosynthesis), lipoxygenase, GST and allene oxide synthase were consistently induced |
| G570 | 866 | 867 | | | |
| G571 | 53 | 871 | KO | Time to senescence | Delayed senescence |
| | | | KO | Flowering time | Late flowering |
| G572 | 873 | 874 | OE | Disease resistance | Increased resistance to *Erysiphe* |
| G573 | 877 | 878 | | | |
| G575 | 881 | 882 | | | |
| G579 | 885 | 886 | | | |
| G582 | 889 | 890 | | | |
| G584 | 44 | 894 | OE | Seed morphology | Large seeds |
| G586 | 897 | 898 | | | |
| G589 | 900 | 901 | | | |
| G590 | 904 | 905 | KO | Seed oil content | Increased seed oil content |
| | | | OE | Flowering time | Early flowering |
| | | | OE | Altered C/N sensing | Greater growth and/or vigor on media with low nitrogen or lacking nitrogen source |
| G591 | 10 | 909 | OE | Disease resistance | Increased resistance to *Erysiphe* |
| | | | OE | Disease resistance | Increased resistance to *Botrytis* |
| | | | OE | Disease resistance | Increased resistance to *Sclerotinia* |
| | | | OE | Flowering time | Late flowering |
| G592 | 101 | 913 | OE | Flowering time | Early flowering |
| G593 | 916 | 917 | | | |
| G595 | 920 | 921 | | | |
| G598 | 78 | 925 | OE | Seed oil content | Increased seed oil |
| | | | OE | Leaf insoluble sugars | Altered insoluble sugars; increased galactose levels |
| G599 | 928 | 929 | OE | Leaf morphology | Extreme rolling and curling of rosette leaves, giving the rosettes a pinwheel-like appearance |
| G603 | 932 | 933 | | | |
| G605 | 79 | 937 | OE | Leaf fatty acids | Altered leaf fatty acid composition; decreased 18:3 and increased 16:0 |
| G607 | 940 | 941 | | | |
| G610 | 944 | 945 | | | |
| G615 | 58 | 949 | OE | Altered architecture | Some plants were bushy and/or had fused cotyledons |
| | | | OE | Fertility | Little or no pollen production, poor filament elongation |
| G616 | 2 | 953 | OE | Disease resistance | Increased resistance to *Erysiphe* |
| G629 | 956 | 957 | OE | Leaf morphology | Altered leaf morphology |
| | | | OE | Seed oil content | Decreased seed oil content |
| | | | OE | Seed protein content | Increased seed protein content |
| G630 | 959 | 960 | OE | Seed protein content | Increased seed protein content |
| | | | OE | Tissue-specific expression | Embryo specific expression |
| G632 | 962 | 963 | | | |
| G633 | 965 | 966 | | | |
| G634 | 969 | 970 | OE | Trichome morphology and number | Increased trichome density and size |
| | | | OE | Altered light response and/or shade tolerance | Increased shade tolerance; lack of shade avoidance phenotype |
| | | | OE | Water deprivation tolerance | More tolerant to desiccation and drought |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G640 | 972 | 973 | | | |
| G641 | 975 | 976 | | | |
| G642 | 979 | 980 | | | |
| G649 | 983 | 984 | | | |
| G653 | 987 | 988 | OE | Altered C/N sensing | Greater growth and/or vigor on media with low nitrogen or lacking nitrogen source |
| G654 | 991 | 992 | | | |
| G656 | 994 | 995 | | | |
| G658 | 998 | 999 | | | |
| G659 | 1002 | 1003 | | | |
| G660 | 1006 | 1007 | | | |
| G661 | 1010 | 1011 | | | |
| G663 | 38 | 1015 | OE | Seed oil content | Decreased seed oil |
| | | | OE | Seed protein content | Increased seed protein |
| | | | OE | Anthocyanins | Increased anthocyanins in leaf, root, seed |
| G664 | 29 | 1019 | OE | Cold tolerance | Increased tolerance to cold; better germination at 8° C. |
| G665 | 1022 | 1023 | | | |
| G666 | 1026 | 1027 | | | |
| G668 | 45 | 1031 | OE | Seed protein content | Increased seed protein content |
| | | | OE | Seed oil content | Decreased seed oil content |
| | | | OE | Seed morphology | Reduced seed color |
| G669 | 1035 | | OE | Morphology | Small, rounded leaf morphology and spindly bolts with low fertility |
| G670 | 1036 | 1037 | OE | Plant size | Small plant |
| G671 | 1040 | 1041 | OE | Stem | Altered inflorescence stem structure |
| | | | OE | Flower | Reduced petal abscission |
| | | | OE | Leaf | Altered leaf shape; true leaves curl down, secondary bolts replaced by odd leaf-like structures |
| | | | OE | Size | Small plant |
| | | | OE | Fertility | Reduced fertility/underdevelopment of flowers |
| G672 | 1044 | 1045 | | | |
| G673 | 1048 | 1049 | | | |
| G675 | 1051 | 1052 | | | |
| G676 | 1055 | 1056 | OE | Trichome | Reduced trichome number, ectopic trichome formation |
| G677 | 1059 | 1060 | | | |
| G679 | 1063 | 1064 | | | |
| G680 | 68 | 1067 | OE | Flowering time | Late flowering |
| | | | OE | Sugar sensing/ glucose tolerance | Reduced germination on 5% glucose medium |
| G682 | 30 | 1071 | OE | Heat tolerance | More tolerance to heat; seedlings were larger and greener in germination and growth assays at 32° C. |
| | | | OE | Salt tolerance | More tolerant to salt; seedlings were larger and greener in a germination assay on 150 mM NaCl |
| | | | OE | Hyperosmotic stress | More tolerant to mannose; more tolerant to sucrose; better germination on a 9.4% sucrose medium |
| | | | OE | Hormone sensitivity | Less sensitive to ABA; seedlings were larger and greener in 0.5 μM ABA in a germination assay |
| | | | OE | Low nutrient tolerance | More tolerant to nitrogen-limiting conditions |
| | | | OE | Altered C/N sensing | Greater growth and/or vigor on media with low nitrogen or lacking nitrogen source |
| | | | OE | Water deprivation tolerance | More tolerant to desiccation and drought |
| | | | OE | Trichome number | Glabrous, lack of trichomes |
| | | | OE | Root morphology | Increased root hair number |
| G699 | 1074 | 1075 | | | |
| G713 | 1077 | 1078 | | | |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G714 | 1080 | 1081 | OE | Leaf morphology | Some lines had long, narrow, curled leaves |
| G718 | 1084 | 1085 | OE | Seed protein content | Increased seed protein |
| | | | OE | Leaf fatty acids | Altered leaf fatty acid composition; decreased 16:0 and 16:3, increased 16:1 and 18:3 |
| | | | OE | Seed prenyl lipids | Increased seed lutein |
| | | | OE | Seed oil content | Decreased seed oil |
| | | | OE | Seed fatty acids | Seed fatty acids; decrease in 18:1 fatty acids in seeds |
| G721 | 1088 | 1089 | | | |
| G723 | 1092 | 1093 | | | |
| G725 | 1096 | 1097 | | | |
| G726 | 1100 | 1101 | | | |
| G727 | 1103 | 1104 | | | |
| G729 | 1107 | 1108 | | | |
| G731 | 1111 | 1112 | | | |
| G732 | 47 | 1116 | OE | Seed protein content | One OE line had increased, another decreased seed protein content |
| | | | OE | Seed oil content | One OE line had increased, another decreased seed oil content |
| | | | OE | Altered architecture | Reduced apical dominance |
| | | | OE | Flower morphology | Abnormal flowers |
| G735 | 1119 | 1120 | | | |
| G736 | 98 | 1123 | OE | Flowering time | Late flowering |
| | | | OE | Leaf morphology | Small, dark green rounded leaves with long petioles |
| G740 | 106 | 1126 | OE | Altered growth rate | Slow growth |
| G743 | 1129 | 1130 | | | |
| G748 | 54 | 1134 | OE | Stem | More vascular bundles in stem |
| | | | OE | Flowering time | Late flowering |
| | | | OE | Seed prenyl lipids | Increased lutein content |
| G749 | 1137 | 1138 | | | |
| G751 | 1141 | 1142 | | | |
| G752 | 1144 | 1145 | OE | Flowering time | Late flowering |
| G759 | 1147 | 1148 | | | |
| G763 | 1150 | 1151 | | | |
| G764 | 1153 | 1154 | | | |
| G773 | 1156 | 1157 | OE | Altered C/N sensing | Increased sensitivity media with low nitrogen or lacking nitrogen source |
| G776 | 39 | 1161 | OE | Seed oil composition | Altered seed fatty acid composition; decreased 20:1 and 22:1 fatty acids |
| G777 | 80 | 1165 | OE | Seed oil content | Decreased seed oil |
| | | | OE | Leaf insoluble sugars | Increased leaf rhamnose |
| G778 | 40 | 1169 | OE | Seed oil composition | Increased seed 18:1 fatty acid |
| G779 | 1172 | 1173 | OE | Fertility | Reduced fertility |
| | | | OE | Flower | Homeotic transformations; conversion of sepals to carpels, most severely affected showed full conversion of sepals to carpels with ovules, stigmatic tissue on Petals and stamens, and in some cases showed organ fusions |
| G780 | 1176 | 1177 | KO | Seed fatty acids | Significant increases in 16:0, 18:0, and 20:0 and decreases in 18:2, 20:1, and 20:2 |
| | | | OE | Seed fatty acids | Significant increase in 18:2 and a significant decrease in 18:3 |
| G782 | 1180 | 1181 | OE | Sugar sensing/ sucrose tolerance | More tolerant to sucrose; better germination on 9.4% sucrose medium |
| G783 | 1184 | 1185 | OE | Sugar sensing/ sucrose tolerance | More tolerant to sucrose; better germination on 9.4% sucrose medium |
| G784 | 1187 | 1188 | | | |
| G786 | 1191 | 1192 | | | |
| G787 | 1194 | 1195 | | | |
| G788 | 1198 | 1199 | | | |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G791 | 1202 | 1203 | OE | Seed oil composition | Decreased decrease in 18:1 seed fatty acid |
| | | | OE | Leaf insoluble sugars | Altered leaf cell wall polysaccharide composition |
| | | | OE | Leaf fatty acid composition | Decreased 18:2 leaf fatty acid |
| G792 | 1206 | 1207 | | | |
| G793 | 1210 | 1211 | OE | Disease resistance | Increased resistance to *Sclerotinia* |
| G795 | 1214 | 1215 | | | |
| G798 | 1218 | 1219 | | | |
| G801 | 1221 | 1222 | OE | Salt tolerance | More tolerant to salt; seedlings were larger and greener in a germination assay on 150 mM NaCl |
| G802 | 1225 | 1226 | | | |
| G804 | 1228 | 1229 | | | |
| G811 | 1232 | 1233 | | | |
| G830 | 1235 | 1236 | | | |
| G832 | 1238 | | | | |
| G849 | 1239 | 1240 | KO | Seed protein content | Altered seed protein content |
| | | | KO | Seed oil content | Increased seed oil content |
| | | | KO | Seed sterols | Decease in β-sitosterol |
| G860 | 1242 | 1243 | | | |
| G864 | 1246 | 1247 | OE | Plant size | Small plant |
| | | | OE | Cold tolerance | Increased adult stage sensitivity to 8° C. |
| | | | OE | Heat tolerance | More tolerance to heat; seedlings were larger and greener in a germination assay at 32° C. |
| G865 | 13 | 1251 | OE | Disease resistance | Increased resistance to *Erysiphe* |
| | | | OE | Disease resistance | Increased susceptibility to *Botrytis* |
| | | | OE | Flowering time | Early flowering |
| | | | OE | Seed protein content | Increased seed protein |
| | | | OE | Altered morphology | Numerous secondary inflorescence meristems-bushy appearance |
| G866 | 1253 | 1254 | OE | Altered C/N sensing | Greater growth and/or vigor on media with low nitrogen or lacking nitrogen source |
| G867 | 69 | 1258 | OE | Sugar sensing/ sucrose tolerance | More tolerant to sucrose; better seedling vigor on 9.4% sucrose medium |
| | | | OE | Salt tolerance | More tolerant to salt; better seedling vigor in a germination assay on 150 mM NaCl |
| | | | OE | Water deprivation tolerance | Increased survival and recovery from drought |
| | | | OE | Hormone sensitivity | Less sensitive to ABA; seedlings were larger and greener in 0.5 μM ABA in a germination assay |
| | | | OE | Cold tolerance | Increased tolerance to cold; at 8° C. in germination and growth assays, some seedlings were larger and during germination and growth |
| G869 | 6 | 1262 | OE | Leaf insoluble sugars | Increase in fucose |
| | | | OE | Seed oil composition | Increased 18:1 seed fatty acids |
| | | | OE | Leaf fatty acids | 16:0 levels decreased and 16:3 levels increased |
| | | | OE | Disease resistance | Increased resistance to *Erysiphe* |
| | | | OE | Morphology: other | Small and spindly plant |
| | | | OE | Flower morphology | Abnormal anther development |
| G872 | 1265 | 1266 | KO | Developmental defects | Embryo lethal |
| | | | OE | Altered C/N sensing | Greater growth and/or vigor on media with low nitrogen or lacking nitrogen source |
| G877 | 1268 | 1269 | KO | Embryo lethal | Embryo lethal phenotype: potential herbicide target |
| G881 | 14 | 1273 | OE | Disease resistance | Increased susceptibility to *Botrytis* |
| | | | OE | Disease resistance | Increased susceptibility to *Erysiphe* |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G883 | 41 | 1277 | OE | Seed prenyl lipids | Decreased seed lutein |
| G886 | 1280 | 1281 | | | |
| G891 | 1284 | 1285 | | | |
| G896 | 15 | 110 | KO | Disease resistance | Increased susceptibility to Fusarium |
| | | | OE | Disease resistance | Increased resistance to Botrytis |
| G897 | 1292 | 1293 | | | |
| G899 | 1296 | 1297 | | | |
| G902 | 1299 | 1300 | | | |
| G908 | 1303 | 1304 | | | |
| G909 | 1307 | 1308 | | | |
| G911 | 31 | 1311 | OE | Low nutrient tolerance | Increased growth on potassium-free medium |
| | | | OE | Seed protein content | Increased seed protein content |
| | | | OE | Seed oil content | Decreased seed oil content |
| G912 | 70 | 1314 | OE | Freezing tolerance | Increased freezing tolerance |
| | | | OE | Altered morphology | Dark green color |
| | | | OE | Water deprivation tolerance | Increased survival and recovery from drought |
| | | | OE | Sugar sensing/ glucose tolerance | Reduced cotyledon expansion in 5% glucose |
| | | | OE | Plant size | Small plant |
| | | | OE | Flowering time | Late flowering |
| | | | OE | Altered C/N sensing | Greater growth and/or vigor on media with low nitrogen or lacking nitrogen source |
| G913 | 1317 | 1318 | OE | Flowering time | Late flowering |
| | | | OE | Freezing tolerance | Increased freezing tolerance |
| | | | OE | Water deprivation tolerance | Increased survival and recovery from drought |
| | | | OE | Cold tolerance | Increased tolerance to cold; more tolerant to 8° C. in a growth assay; some seedlings had less anthocyanin |
| G914 | 1321 | 1322 | | | |
| G915 | 1325 | 1326 | | | |
| G921 | 1329 | 1330 | OE | Hyperosmotic stress tolerance | Increased sensitivity to 10% polyethylene glycol or 150 mM salt |
| | | | OE | Leaf | Serrated leaves |
| G927 | 1333 | 1334 | | | |
| G928 | 1337 | 1338 | OE | Sugar sensing/sucrose tolerance | More tolerant to sucrose; better germination on 9.4% sucrose medium |
| | | | OE | Water deprivation tolerance | More tolerant to desiccation |
| | | | OE | Cold tolerance | More tolerant to cold; in an 8° C. germination assay, seedlings were larger and had less anthocyanin |
| G929 | 1341 | 1342 | | | |
| G932 | 1345 | 1346 | OE | Leaf morphology | Altered development, dark green color |
| | | | OE | Plant size | Reduced size |
| | | | OE | Altered C/N sensing | Greater growth and/or vigor on media with low nitrogen or lacking nitrogen source |
| G938 | 42 | 1350 | OE | Seed oil composition | Overexpressors had increased 16:0, 18:0, 20:0, and 18:3 fatty acids, decreased 18:2, 20:1, 22:1 fatty acids |
| G939 | 1353 | 1354 | | | |
| G941 | 1357 | 1358 | | | |
| G942 | 1363 | 1361 | | | |
| G960 | 1364 | 1365 | | | |
| G964 | 32 | 1369 | OE | Heat tolerance | More tolerance to heat; seedlings were larger and greener in a germination assay at 32° C. |
| | | | KO | Altered C/N sensing | Greater growth and/or vigor on media with low nitrogen or lacking nitrogen source |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G965 | 1371 | 1372 | OE | Seed oil composition | Increase in 18:1 fatty acid |
| G975 | 84 | 1376 | OE | Leaf fatty acids | Increased wax in leaves |
| | | | OE | Altered C/N sensing | Greater growth and/or vigor on media with low nitrogen or lacking nitrogen source |
| | | | OE | Water deprivation tolerance | Increased survival and recovery from drought |
| G976 | 1379 | 1380 | | | |
| G977 | 1383 | 1384 | OE | Plant size | Small plant |
| | | | OE | Morphology: color | Dark green |
| | | | OE | Leaf morphology | Altered leaf shape; generally wrinkled or curled |
| | | | OE | Fertility | Reduced fertility; underdeveloped flowers, abnormal inflorescences |
| G986 | 1387 | 1388 | | | |
| G987 | 1391 | 1392 | KO | Leaf fatty acids | Reduction in 16:3 fatty acid |
| | | | KO | Leaf prenyl lipids | Presence of two xanthophylls, tocopherol not normally found in leaves; reduced chlorophyll a and b |
| G994 | 95 | 1396 | OE | Flowering time | Late flowering |
| | | | OE | Plant size | Small plants |
| G996 | 71 | 1400 | OE | Sugar sensing/ glucose tolerance | Reduced germination on 5% glucose medium |
| G997 | 1403 | 1404 | | | |
| G998 | 1407 | 1408 | | | |
| G1000 | 1413 | 1411 | | | |
| G1004 | 1414 | 1415 | | | |
| G1005 | 1418 | 1419 | | | |
| G1006 | 1422 | 1423 | OE | Disease resistance | Increased resistance to *Erysiphe* |
| | | | OE | Disease resistance | Increased resistance to *Sclerotinia* |
| G1008 | 1426 | 1427 | OE | Plant morphology | Overexpressors were small and bushy |
| G1017 | 1430 | 1431 | | | |
| G1020 | 1434 | 1435 | OE | Plant size | Very small T1 plants |
| G1021 | 1438 | 1439 | | | |
| G1025 | 1442 | 1443 | | | |
| G1030 | 1445 | 1446 | | | |
| G1034 | 1448 | 1449 | | | |
| G1038 | 51 | 1452 | OE | Leaf morphology | Rounded leaves |
| | | | OE | Leaf insoluble sugars | Decreased insoluble sugars |
| G1039 | 1454 | 1455 | | | |
| G1040 | 1458 | 1459 | OE | Seed morphology | Smaller and more rounded seeds |
| G1045 | 1462 | 1463 | | | |
| G1048 | 1466 | 1467 | OE | *Erysiphe* | Increased tolerance to *Erysiphe orontii* |
| | | | OE | Seed protein content | Increased seed protein content |
| | | | OE | Altered light response and/or shade tolerance | Increased shade tolerance; lack of shade avoidance phenotype |
| G1052 | 1469 | 1470 | OE | Flowering time | Late flowering |
| | | | OE | Seed prenyl lipids | Decrease in lutein and increase in xanthophyll 1 |
| G1055 | 1473 | 1474 | | | |
| G1057 | 1476 | 1477 | | | |
| G1058 | 1480 | 1481 | | | |
| G1060 | 1484 | | | | |
| G1061 | 1487 | 1488 | | | |
| G1065 | 1491 | 1492 | | | |
| G1067 | 1494 | 1495 | OE | Leaf morphology | Upcurled rosette leaves |
| | | | OE | Plant size | Small plant |
| | | | OE | Fertility | Reduced fertility |
| | | | OE | Water deprivation tolerance | Increased survival and recovery from drought |
| | | | OE | Hormone sensitivity | Less sensitive to ABA; seedlings were larger and greener in 0.5 μM ABA in a germination assay |
| G1068 | 72 | 1499 | OE | Sugar sensing/glucose tolerance | Reduced cotyledon expansion in 5% glucose |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G1071 | 1502 | 1503 | | | |
| G1072 | 1506 | 1507 | | | |
| G1073 | 59 | 1511 | OE | Plant size | Increased plant size |
| | | | OE | Seed morphology | Larger seeds; increased seed yield |
| | | | OE | Leaf | Serrated leaves |
| | | | OE | Flowering time | Flowering slightly delayed |
| | | | OE | Salt tolerance | More tolerant to salt; seedlings were larger and greener in a germination assay on 150 mM NaCl |
| | | | OE | Sugar sensing/sucrose tolerance | More tolerant to sucrose; better germination on 9.4% sucrose medium |
| | | | OE | Hyperosmotic stress | More tolerant to mannitol; greater germination and growth on 300 mM mannitol medium |
| | | | OE | Water deprivation tolerance | More tolerant to desiccation and drought |
| G1075 | 1514 | 1515 | OE | Plant size | Small plant |
| | | | OE | Flower morphology | Reduced or absent petals, sepals and stamens |
| | | | OE | Fertility | Reduced fertility |
| | | | OE | Leaf morphology | Pointed leaves in some seedlings; twisted or curled leaves and serrations in rosette stage |
| G1078 | 1518 | 1519 | | | |
| G1082 | 1521 | 1522 | | | |
| G1083 | 1525 | 1526 | | | |
| G1090 | 1529 | 1530 | OE | Altered C/N sensing | Greater growth and/or vigor on media with low nitrogen or lacking nitrogen source |
| G1093 | 1532 | 1533 | | | |
| G1095 | 1536 | 1537 | | | |
| G1099 | 1540 | 1541 | | | |
| G1100 | 1544 | 1545 | OE | Altered light response and/or shade tolerance | Increased shade tolerance; lack of shade avoidance phenotype |
| G1107 | 1548 | 1549 | | | |
| G1109 | 1552 | 1553 | | | |
| G1130 | 1556 | 1557 | | | |
| G1131 | 1560 | 1561 | | | |
| G1133 | 81 | 1565 | OE | Leaf prenyl lipids | Decreased leaf lutein |
| G1134 | 1567 | 1568 | OE | Silique morphology | Siliques with altered shape |
| | | | OE | Hormone sensitivity | Altered response to ethylene: longer hypocotyls and lack of apical hook |
| | | | OE | Hormone sensitivity | Less sensitive to ABA; seedlings were larger and greener in 0.5 μM ABA in a germination assay |
| | | | OE | Root morphology | Several seedlings had more root growth |
| G1137 | 1571 | 1572 | | | |
| G1141 | 1575 | 1576 | | | |
| G1149 | 1578 | 1579 | | | |
| G1181 | 1582 | 1583 | OE | Plant size | Small T1 plants |
| G1196 | 1585 | 1586 | | | |
| G1197 | 1588 | 1589 | | | |
| G1202 | 1592 | 1593 | OE | Leaf fatty acids | Significant increase (>2 standard deviation) in 18:0 and 18:1 fatty acids; decrease in 18:3 saturated fatty acids in leaves |
| G1207 | 1595 | 1596 | | | |
| G1208 | 1600 | 1598 | | | |
| G1218 | 1601 | 1602 | | | |
| G1228 | 1606 | 1604 | OE | Plant size | Reduced size |
| G1232 | 1607 | 1608 | | | |
| G1233 | 1610 | 1611 | | | |
| G1240 | 1613 | 1614 | | | |
| G1241 | 1616 | 1617 | | | |
| G1249 | 1619 | 1620 | | | |
| G1258 | 1623 | 1624 | | | |
| G1261 | 1627 | 1628 | | | |
| G1266 | 82 | 1632 | OE | Leaf fatty acids | Decreased 16:0, 18:2, increased 18:3 |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| | | | OE | Disease resistance | Increased resistance to *Erysiphe* |
| | | | OE | Disease resistance | Increased resistance to *Botrytis* |
| | | | OE | Disease resistance | Increased resistance to *Sclerotinia* |
| | | | OE | Plant size | Small plant |
| | | | OE | Fertility | Reduced fertility |
| | | | OE | Leaf insoluble sugars | Alterations in xylose, and mannose, and galactose concentrations; decreased rhamnose, some lines had more arabinose |
| | | | OE | Altered C/N sensing | Greater growth and/or vigor on media with low nitrogen or lacking nitrogen source |
| | | | OE | Salt tolerance | More tolerant to salt; seedlings were larger and greener in a germination assay on 150 mM NaCl |
| | | | OE | Hyperosmotic stress | More tolerant to mannitol; greater germination and growth on 300 mM mannitol medium |
| | | | OE | Hormone sensitivity | Less sensitive to ABA; seedlings were larger and greener in 0.5 µM ABA in a germination assay |
| | | | OE | Cold tolerance | Increased tolerance to cold; in an 8° C. germination assay, seedlings were larger, greener and had less anthocyanin |
| G1269 | 50 | 1636 | OE | Leaf morphology | Long petioles, upturned leaves |
| G1275 | 1639 | 1640 | OE | Plant size | Small plant |
| | | | OE | Altered architecture | Reduced apical dominance |
| | | | OE | Heat tolerance | More tolerance to heat; seedlings were larger and greener in a germination assay at 32° C. |
| | | | OE | Cold tolerance | More tolerant to cold; in 8° C. germination and growth assays; some seedlings were larger and had less anthocyanin |
| | | | OE | Hormone sensitivity | Less sensitive to ABA; seedlings were larger and greener in 0.5 µM ABA in a germination assay |
| G1293 | 1643 | | | | |
| G1300 | 1644 | 1645 | OE | Seed fatty acids | One line had a reduction in 16:0, 18:0 and 20:0 seed fatty acids and an increase in the unsaturated 18:1 and 18:2 fatty acids; another line had significant increases in 16:0, 18:0 and 20:0 fatty acids and a reduction in 20:1 |
| G1309 | 1647 | 1648 | OE | Plant size | Small plant |
| | | | OE | Leaf insoluble sugars | Increased mannose |
| G1311 | 1651 | 1652 | OE | Fertility | Reduced fertility |
| | | | OE | Plant size | Small plant |
| G1315 | 1655 | 1656 | OE | Leaf chemistry | Increased leaf β-carotene |
| G1319 | 1659 | 1660 | | | |
| G1321 | 1663 | 1664 | | | |
| G1323 | 1667 | 1668 | OE | Seed oil content | Decreased seed oil |
| | | | OE | Seed protein content | Increased seed protein |
| | | | OE | Plant size | Small T1 plants |
| | | | OE | Morphology: color | Dark green |
| G1324 | 83 | 1672 | OE | Leaf prenyl lipids | Decreased leaf lutein, increased leaf xanthophyll |
| G1326 | 1675 | 1676 | OE | Flower morphology | Petals and sepals were smaller |
| | | | OE | Plant size | Small plant |
| | | | OE | Fertility | Reduced fertility |
| G1327 | 1679 | 1680 | OE | Leaf morphology | Dark green leaves |
| G1328 | 43 | 1684 | OE | Seed prenyl lipids | Decreased seed lutein |
| G1329 | 1687 | 1688 | | | |
| G1333 | 1691 | 1692 | | | |
| G1334 | 104 | 1696 | OE | Plant size | Some lines were small |
| | | | OE | Plant size | Larger seedlings |
| | | | OE | Leaf morphology | Dark green leaves |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G1335 | 96 | 1700 | OE | Flowering time | Late flowering |
|  |  |  | OE | Dev and morph | Slow growth |
| G1337 | 73 | 1704 | OE | Sugar sensing | Decreased germination on 9.4% sucrose medium |
|  |  |  | OE | Leaf fatty acids | Altered leaf fatty acid composition |
| G1338 | 1706 | 1707 |  |  |  |
| G1340 | 1710 | 1711 |  |  |  |
| G1349 | 1714 | 1715 |  |  |  |
| G1350 | 1718 | 1719 |  |  |  |
| G1351 | 1721 | 1722 |  |  |  |
| G1352 | 1725 | 1726 |  |  |  |
| G1355 | 1728 | 1729 | OE | Seed oil content | Reduced seed oil |
| G1363 | 1732 | 1733 | OE | Disease resistance | Increased resistance to *Fusarium* |
|  |  |  | OE | Water deprivation | Increased tolerance to desiccation |
| G1366 | 1736 | 1737 |  |  |  |
| G1367 | 1740 | 1741 |  |  |  |
| G1383 | 1744 | 1745 |  |  |  |
| G1385 | 1748 | 1749 |  |  |  |
| G1389 | 1752 | 1753 |  |  |  |
| G1390 | 1756 | 1757 |  |  |  |
| G1394 | 1760 | 1761 |  |  |  |
| G1395 | 1764 | 1765 |  |  |  |
| G1396 | 1768 | 1769 |  |  |  |
| G1398 | 1772 | 1773 |  |  |  |
| G1403 | 1776 | 1777 | KO | Seed fatty acids | Increased 16:0 and 18:0 and decreased 20:2 seed fatty acids |
| G1411 | 1780 | 1781 | OE | Altered architecture | Loss of apical dominance |
| G1416 | 1784 | 1785 |  |  |  |
| G1419 | 1788 | 1789 | OE | Altered seed protein | Increased seed protein |
| G1427 | 1792 | 1793 |  |  |  |
| G1435 | 99 | 1796 | OE | Flowering time | Late flowering |
|  |  |  | OE | Plant size | Increased plant size |
|  |  |  | OE | Leaf morphology | Dark green leaves |
| G1437 | 1799 | 1800 |  |  |  |
| G1438 | 1802 | 1803 |  |  |  |
| G1439 | 1805 | 1806 |  |  |  |
| G1443 | 1808 | 1809 |  |  |  |
| G1449 | 1811 | 1812 | OE | Seed protein content | Increased seed protein content |
|  |  |  | OE | Flower morphology | Larger flowers with more open petals; extra petals |
| G1456 | 1815 | 1816 |  |  |  |
| G1466 | 1819 | 1820 |  |  |  |
| G1489 | 1823 | 1824 |  |  |  |
| G1496 | 1826 | 1827 | OE | Altered seed oil | Increased seed oil content |
| G1499 | 1830 | 1831 | OE | Architecture | Bolts terminating without an inflorescence; in some lines, flowers replaced with filamentous structures or carpelloid structures; less severely affected lines produced flowers where sepals were converted to carpelloid tissue |
|  |  |  | OE | Flower morphology | Petals and stamens were absent or reduced in size and number |
|  |  |  | OE | Morphology: other | Dark green leaves |
| G1509 | 1834 | 1835 |  |  |  |
| G1514 | 1837 | 1838 | OE | Disease resistance | Increased susceptibility to *Botrytis* |
| G1518 | 1840 | 1841 |  |  |  |
| G1519 | 1843 | 1844 | KO | Embryo lethal | Embryo lethal phenotype: potential herbicide target |
| G1526 | 1848 | 1846 | KO | Altered seed oil | Increased seed oil content |
| G1528 | 1849 | 1850 |  |  |  |
| G1537 | 1852 | 1853 |  |  |  |
| G1538 | 1856 | 1857 |  |  |  |
| G1540 | 1860 | 1861 | OE | Cell differentiation | Reduced cell differentiation in meristem |
| G1541 | 1864 | 1865 |  |  |  |
| G1542 | 1868 | 1869 |  |  |  |

TABLE 5-continued

Sequences and traits observed when expression of the sequences was modified in plants

| GID | DNA SEQ ID NO: | PRT SEQ ID NO: | Overexpressor (OE) or Knockout (KO) | Trait Category | Experimental Observation |
|---|---|---|---|---|---|
| G1543 | 1872 | 1873 | OE | Altered architecture | Compact plant |
|  |  |  | OE | Morphology: color | Dark green color |
|  |  |  | OE | Seed oil content | Decreased seed oil |
|  |  |  | OE | Altered leaf prenyl lipids | Increase in chlorophyll a and b |
| G1550 | 1876 | 1877 |  |  |  |
| G1586 | 1880 | 1881 | OE | Leaf morphology | Narrow leaves |
| G1634 | 1884 | 1885 | OE | Seed protein content | Decreased seed protein content |
|  |  |  | OE | Seed oil content | Increased seed oil |
| G1635 | 1888 | 1889 | OE | Morphology | Primary transformant had reduced apical dominance, reduced bolt elongation, narrow rosette leaves, and poor fertility |
| G1636 | 1892 | 1893 |  |  |  |
| G1638 | 1896 | 1897 |  |  |  |
| G1640 | 1900 | 1901 | OE | Seed oil content | Increased seed oil |
| G1643 | 1906 | 1904 |  |  |  |
| G1646 | 1907 | 1908 | OE | Seed oil content | Increased seed oil |
|  |  |  | OE | Cold tolerance | More tolerant to cold; in an 8° C. germination assay, some seedlings were larger and had less anthocyanin |
|  |  |  | OE | Water deprivation | More tolerant to desiccation |
| G1650 | 1911 | 1912 |  |  |  |
| G1653 | 1915 | 1916 |  |  |  |
| G1655 | 1919 | 1920 |  |  |  |
| G1664 | 1923 | 1924 |  |  |  |
| G1667 | 1927 | 1928 | OE | Seed protein content | Increased seed protein content |
|  |  |  | OE | Seed oil content | Decreased seed oil |
|  |  |  | OE | Leaf prenyl lipids | Increased β-carotene |
| G1669 | 1931 | 1932 |  |  |  |
| G1699 | 1934 | 1935 |  |  |  |
| G1705 | 1938 | 1939 |  |  |  |
| G1742 | 1942 | 1943 |  |  |  |
| G1773 | 1947 |  | KO | Altered C/N sensing | Greater growth and/or vigor on media with low nitrogen or lacking nitrogen source |
| G1785 | 1948 | 1949 |  |  |  |
| G1787 | 1953 |  |  |  |  |
| G1807 | 1955 |  | OE | Oxidative stress | More sensitive to acifluorfen |
| G1836 | 1956 | 1957 | OE | Salt tolerance | More tolerant to salt; seedlings were larger and greener in a germination assay on 150 mM NaCl |
|  |  |  | OE | Sugar sensing/sucrose tolerance | More tolerant to sucrose; better germination on 9.4% sucrose medium |
|  |  |  | OE | Hormone sensitivity | Less sensitive to ABA; seedlings were larger and greener in 0.5 μM ABA in a germination assay |
|  |  |  | OE | Cold tolerance | More tolerant to cold; in an 8° C. germination assay; seedlings were larger, greener and had less anthocyanin |
|  |  |  | OE | Water deprivation tolerance | Increased survival and recovery from drought |
|  |  |  | OE | Flowering time | Some lines slightly early flowering |
| G1894 | 1960 | 1961 |  |  |  |
| G1900 | 1963 | 1964 | OE | Flowering time | Late flowering |
| G1901 | 1966 | 1967 |  |  |  |
| G1903 | 1969 | 1970 | OE | Seed protein content | Decreased seed protein content |
| G1911 | 1972 | 1973 |  |  |  |
| G1917 | 1976 | 1977 | KO | Seed glucosinolate | Significant increase in peak M39489 |
| G2019 | 1979 |  | KO | Leaf prenyl lipids | Significant (>2 standard deviation) increase in the leaf prenyl lipids, xanthophylls |
| G2484 | 1980 | 1981 |  |  |  |

Example X

Plants Overexpressing G1435 (SEQ ID NOs: 99 and 1796; a GARP Family Transcription Factor)

G1435 (SEQ ID NO: 99 and polypeptide SEQ ID NO: 1796) was isolated as a cDNA clone. G1435 was later identified in the sequence of BAC F2015, GenBank accession number AB025604, released by the *Arabidopsis* Genome Initiative.

Experimental observations. The complete sequence of G1435 was determined. The function of this gene was analyzed using transgenic plants in which G1435 was expressed under the control of the 35S promoter. Plants overexpressing G1435 were larger than wild-type controls, and had dark green leaves. Primary transformants were late flowering. G1435 was expressed throughout the plant, though at lower levels in roots and germinating seeds. It is not significantly induced or repressed by any condition tested.

A second experiment in which 35S::G1435 plants were grown confirmed the late flowering phenotype of three T2 lines. G1435 could thus be used to influence flowering time in crop plants. In species such as sugarbeet where the vegetative parts of the plants constitute the crop and the reproductive tissues are discarded, it would be advantageous to delay or prevent flowering. Extending vegetative development could bring about large increases in yields.

Another potential indicator of increased yield conferred by G1435 overexpression was the increased plant size and green color (suggesting increased photosynthetic capacity). It was thus expected that G1435 may be useful for increasing yield and/or crop quality in crops, including where the vegetative portion of the plant is harvested. A confirmation of an increase in yield in a commercially important plant species was provided when a field trial of corn plants overexpressing G1435 showed two lines with significantly increased broad acre yield relative to negative segregant controls (Table 6). These lines, 642 and 653, showed increased total kernel number and total kernel weight. Line 653 showed the higher percentage increase (a statistically significant increase) in photosynthesis compared to the negative segregant controls.

TABLE 6

Results in field trials comparing means of yield of transgenics to negative segregant controls

| Line | Mean yield, overexpressor | Mean yield, control | Difference | Percent difference | p value |
|---|---|---|---|---|---|
| 641 | 213.418 | 226.181 | −12.763 | −5.643 | 0.002 |
| 665 | 223.890 | 226.181 | −2.291 | −1.013 | 0.586 |
| 649 | 224.233 | 226.181 | −1.948 | −0.862 | 0.644 |
| 662 | 228.127 | 226.181 | 1.946 | 0.860 | 0.644 |
| 660 | 221.525 | 226.181 | −4.656 | −2.059 | 0.269 |
| 646 | 215.764 | 226.181 | −10.417 | −4.606 | 0.014 |
| 656 | 227.422 | 226.181 | 1.241 | 0.548 | 0.769 |
| 664 | 226.313 | 226.181 | 0.132 | 0.058 | 0.975 |
| 642* | 232.418 | 226.181 | 6.237 | 2.757 | 0.138 |
| 653* | 234.244 | 226.181 | 8.063 | 3.565 | 0.056 |
| 654 | 229.372 | 226.181 | 3.191 | 1.410 | 0.448 |
| 651 | 230.383 | 226.181 | 4.202 | 1.858 | 0.319 |

*Increased yield in these lines observed ($p < 0.15$)

Example XI

Utilities of G1435 (SEQ ID NOs: 99 and 1796) and its Phylogenetically-Related Sequences Based on the data obtained in the above-disclosed Example, the darker green color, increased photosynthesis, increased plant size and increased yield of G1435 overexpressors all indicate that G1435-related sequence overexpression can directly result in improved yield of crop plants, ornamental plants, and woody plants used in the food, ornamental, paper, pulp, lumber or other industries.

The invention thus includes G1435-overexpressing plants, and methods for producing G1435-overexpressing plants, or delaying flowering, increasing size, increasing photosynthesis, or increasing yield in a plant where the plant overexpresses G1435 or a phylogenetically and functionally-related sequence.

Example XII

Transformation of Dicots to Produce Increased Photosynthesis, Yield or Stress Tolerance Crop species that overexpress polypeptides of the invention may produce plants with increased photosynthetic capacity and/or yield, and/or increased tolerance to water deprivation, cold and/or nutrient tolerance in both stressed and non-stressed conditions. Thus, polynucleotide sequences listed in the Sequence Listing recombined into, for example, one of the expression vectors of the invention, or another suitable expression vector, may be transformed into a plant for the purpose of modifying plant traits for the purpose of improving yield and/or quality. The expression vector may contain a constitutive, tissue-specific or inducible promoter operably linked to the polynucleotide. The cloning vector may be introduced into a variety of plants by means well known in the art such as, for example, direct DNA transfer or *Agrobacterium tumefaciens*-mediated transformation. It is now routine to produce transgenic plants using most dicot plants (see Weissbach and Weissbach (1989) *Methods for Plant Molecular Biology*, Academic Press; Gelvin et al. (1990) *Plant Molecular Biology Manual*, Kluwer Academic Publishers; Herrera-Estrella et al. (1983) *Nature* 303: 209; Bevan (1984) *Nucleic Acids Res.* 12: 8711-8721; and Klee (1985) *Bio/Technology* 3: 637-642). Methods for analysis of traits are routine in the art and examples are disclosed above.

Numerous protocols for the transformation of tomato and soy plants have been previously described, and are well known in the art. Gruber et al. (1993), in Glick and Thompson (1993) *Methods in Plant Molecular Biology and Biotechnology*, eds., CRC Press, Inc., Boca Raton, describe several expression vectors and culture methods that may be used for cell or tissue transformation and subsequent regeneration. For soybean transformation, methods are described by Miki et al. (1993) in *Methods in Plant Molecular Biology and Biotechnology*, p. 67-88, Glick and Thompson, eds., CRC Press, Inc., Boca Raton; and U.S. Pat. No. 5,563,055, (Townsend and Thomas), issued Oct. 8, 1996.

There are a substantial number of alternatives to *Agrobacterium*-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al. (1987) Part. Sci. Technol. 5:27-37; Sanford (1993) *Methods Enzymol.* 217: 483-509;

Christou et al. (1992) *Plant. J.* 2: 275-281; Klein et al. (1987) *Nature* 327: 70-73; U.S. Pat. No. 5,015,580 (Christou et al), issued May 14, 1991; and U.S. Pat. No. 5,322,783 (Tomes et al.), issued Jun. 21, 1994).

Alternatively, sonication methods (see, for example, Zhang et al. (1991) *Bio/Technology* 9: 996-997); direct uptake of DNA into protoplasts using $CaCl_2$ precipitation, polyvinyl alcohol or poly-L-ornithine (see, for example, Hain et al. (1985) *Mol. Gen. Genet.* 199: 161-168; Draper et al. (1982) *Plant Cell Physiol.* 23: 451-458); liposome or spheroplast fusion (see, for example, Deshayes et al. (1985) *EMBO J.*, 4: 2731-2737; Christou et al. (1987) *Proc. Natl. Acad. Sci. USA* 84: 3962-3966); and electroporation of protoplasts and whole cells and tissues (see, for example, Donn et al. (1990) in *Abstracts of VIIth International Congress on Plant Cell and Tissue Culture IAPTC*, A2-38: 53; D'Halluin et al. (1992) *Plant Cell* 4: 1495-1505; and Spencer et al. (1994) *Plant Mol. Biol.* 24: 51-61) have been used to introduce foreign DNA and expression vectors into plants.

After a plant or plant cell is transformed (and the latter regenerated into a plant), the transformed plant may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al (1986) In *Tomato Biotechnology*: Alan R. Liss, Inc., 169-178, and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 µM α-naphthalene acetic acid and 4.4 µM 6-benzylaminopurine. The explants are then infected with a diluted overnight culture of *Agrobacterium tumefaciens* containing an expression vector comprising a polynucleotide of the invention for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7) to an $OD_{600}$ of 0.8.

Following cocultivation, the cotyledon explants are transferred to Petri dishes with selective medium comprising MS medium with 4.56 µM zeatin, 67.3 µM vancomycin, 418.9 µM cefotaxime and 171.6 µM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055 (Townsend et al., issued Oct. 8, 1996), described in brief here. In this method soybean seed is surface sterilized by exposure to chlorine gas evolved in a glass bell jar. Seeds are germinated by plating on 1/10 strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

Overnight cultures of *Agrobacterium tumefaciens* harboring the expression vector comprising a polynucleotide of the invention are grown to log phase, pooled, and concentrated by centrifugation. Inoculations are conducted in batches such that each plate of seed was treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Example XIII

Transformation of Monocots to Produce Increased Photosynthesis Yield or Abiotic Stress Tolerance Cereal plants such as, but not limited to, corn, wheat, rice, sorghum, or barley, may be transformed with the present polynucleotide sequences, including monocot or dicot-derived sequences such as those presented in the present Tables, cloned into a vector such as pGA643 and containing a kanamycin-resistance marker, and expressed constitutively under, for example, the CaMV 35S or COR15 promoters, or with tissue-specific or inducible promoters. The expression vectors may be one found in the Sequence Listing, or any other suitable expression vector may be similarly used. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3\times10^{-9}$ cells of *Agrobacterium* containing the cloning vector for 3-10 minutes. The callus material is cultured on solid medium at 25° C. in the dark for several days. The calli grown on this medium are transferred to Regeneration medium. Transfers are continued every 2-3 weeks (2 or 3 times) until shoots develop. Shoots are then transferred to Shoot-Elongation medium every 2-3 weeks. Healthy looking shoots are transferred to rooting medium and after roots have developed, the plants are placed into moist potting soil.

The transformed plants are then analyzed for the presence of the NPTII gene/kanamycin resistance by ELISA, using the ELISA NPTII kit from 5Prime-3Prime Inc. (Boulder, Colo.).

It is also routine to use other methods to produce transgenic plants of most cereal crops (Vasil (1994) *Plant Mol. Biol.* 25: 925-937) such as corn, wheat, rice, sorghum (Cassas et al. (1993)), and barley (Wan and Lemeaux (1994)). DNA transfer methods such as the microprojectile method can be used for corn (Fromm et al. (1990); Gordon-Kamm et al. (1990); Ishida (1990)), wheat (Vasil et al. (1992) *Bio/Technol.* 10:667-674; Vasil et al. (1993) *Bio/Technol.* 11: 1553-1558; Weeks et al. (1993) *Plant Physiol.* 102: 1077-1084), and rice (Christou (1991) *Bio/Technol.* 9:957-962; Hiei et al. (1994) *Plant J.* 6:271-282; Aldemita and Hodges (1996) *Planta* 199: 612-617; and Hiei et al. (1997) *Plant Mol. Biol.* 35:205-218). For most cereal plants, embryogenic cells derived from immature scutellum tissues are the preferred cellular targets for transformation (Hiei et al. (1997) supra; Vasil (1994) supra). For transforming corn embryogenic cells derived from immature scutellar tissue using microprojectile bombardment, the A188XB73 genotype is the preferred genotype (Fromm et al. (1990) *Bio/Technol.* 8: 833-839; Gordon-Kamm et al. (1990) *Plant Cell* 2: 603-618). After microprojectile bombardment the tissues are selected on phosphinothricin to identify the transgenic embryogenic cells (Gordon-Kamm et al. (1990) supra). Transgenic plants are regenerated by standard corn regeneration techniques (Fromm et al. (1990) supra; Gordon-Kamm et al. (1990) supra).

Example XIV

Expression and Analysis of Increased Photosynthesis Yield or Abiotic Stress Tolerance in Non-*Arabidopsis* Species It is expected that structurally similar orthologs of the G1435 clade of polypeptide sequences, including those found in the Sequence Listing, can confer increased yield relative to control plants. As sequences of the invention have been shown to increase photosynthesis and/or yield in a variety of plant species, it is also expected that these sequences will increase yield of crop or other commercially important plant species.

Northern blot analysis, RT-PCR or microarray analysis of the regenerated, transformed plants may be used to show expression of a polypeptide or the invention and related genes that are capable of inducing abiotic stress tolerance, and/or larger size.

After a dicot plant, monocot plant or plant cell has been transformed (and the latter regenerated into a plant) and shown to have greater size, improved yield, or able to tolerate greater planting density with a coincident increase in yield, the transformed monocot plant may be crossed with itself or a plant from the same line, a non-transformed or wild-type monocot plant, or another transformed monocot plant from a different transgenic line of plants.

The function of specific polypeptides of the invention, including closely-related orthologs, have been analyzed and may be further characterized and incorporated into crop plants. The ectopic overexpression of these sequences may be regulated using constitutive, inducible, or tissue specific regulatory elements. Genes that have been examined and have been shown to modify plant traits (including increasing yield and/or abiotic stress tolerance) encode polypeptides found in the Sequence Listing. In addition to these sequences, it is expected that newly discovered polynucleotide and polypeptide sequences closely related to polynucleotide and polypeptide sequences found in the Sequence Listing can also confer alteration of traits in a similar manner to the sequences found in the Sequence Listing, when transformed into any of a considerable variety of plants of different species, and including dicots and monocots. The polynucleotide and polypeptide sequences derived from monocots (e.g., the rice sequences) may be used to transform both monocot and dicot plants, and those derived from dicots (e.g., the *Arabidopsis* and soy genes) may be used to transform either group, although it is expected that some of these sequences will function best if the gene is transformed into a plant from the same group as that from which the sequence is derived.

Sequences of the invention, that is, members of the G1435 clade, may also be used to generate transgenic plants that have increased photosynthetic capacity, produce larger plants and/ or greater yield than control plants.

It is expected that the same methods may be applied to identify other useful and valuable sequences of the present polypeptide clades, and the sequences may be derived from a diverse range of species.

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (2002 sequences)

SEQ ID NO: 1 - DNA, 1195 bp, Arabidopsis thaliana
  G188
ctctcaccaacataatcaaagaagctttcctcacgaattcaagatcgccatgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatgatgaaaacgaataaaatctcaatttacaatttacaaaaagaaaaaagtcagtttttaattattatttttgtttgttaaaacttgacatttattgtgttat

SEQ ID NO: 2 - DNA, 1431 bp, Arabidopsis thaliana
  G616
ctttaaatcccaaaccaaccctaaagttttgatttttaattttgggggtaaccaaaaaaaaaacaaaaccctaattttttttctttagtgatgagattattggtgatgatgaaatgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactgatgatattaattattgcatctttggttttgttcaaatgctcattttgtatgtttatctttggtttatttcaaaacaaatgttaatctctttcgttgtctgatgtgtgttagggttttgttttatgtattgagggtctttggaaatctttttgcattgtgcttgtaatgttgtatttgtgataatagcattttgtttgtgagttaaaaaaaaaaaaaaaaaa

SEQ ID NO: 3 - DNA, 1055 bp, Arabidopsis thaliana
  G19
ataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttctt

SEQ ID NO: 4 - DNA, 1857 bp, Arabidopsis thaliana
  G261
gtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatggttttagaaaagctgatcctgagcaatgggaatttgcgaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattccagtacttaggtatggttcagctgtttatttatcacttgtatgatctttcccagttcattgtagcagacttcaatggtaatgataagctagagcttatggatagtattcataaaaaaa

SEQ ID NO: 5 - DNA, 964 bp, Arabidopsis thaliana
  G28
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaaaaa

SEQ ID NO: 6 - DNA, 1571 bp, Arabidopsis thaliana
  G869
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 7 - DNA, 920 bp, Arabidopsis thaliana
  G237
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 8 - DNA, 1302 bp, Arabidopsis thaliana
  G409
tgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttgttgtttccatgttgacgataattgttgactcgtggaataattccgctgttcaacggtatttttatcagttgcattatatgcttttatgaaaaaaaaaa

SEQ ID NO: 9 - DNA, 2545 bp, Arabidopsis thaliana
  G418
acatatgttttaaattctttgtctgaatcttacaggatccgagagagagagctctggaacgatattaacatatatcatgaagaaaaagattgaagtattgatatgggaataactaaaacttctcctaatactacaattctcttgaagacttttcacaataattctatgtcccaagattatcatcatcatcatcatcataatcaacaccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccaacagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagcaacgtgcgtttcatcaaatgggtatgatggaacaagaagcttggcggccacaacgcggtttgcctgaacgctccgtcaatatacttagagcttggctcttcgaacatttccttcacccgtatccaagtgatgcagataaacacctattggctcgacagactggtttatccagaaatcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccaccgtctaagatccaacattaatgcttacgaaaacgacgcttcatcacttctactcccttcctcttattccaacgccgccgctcctgccgctgtttctgacgacttgaattctcgttacggtggctcagacgcgttttccgccgttgccacgtgtcaacaaagtgtaggtgggttcgatgatgctgacatggatggtgttaacgttataaggtttgggacaaaccctactggtgacgtgtctctcacgcttggtttacgccacgctggaaacatgcctgacaaagacgcttctttctgcgttagagagtttgggggtttttagtttgcttttgtcactccatttaattaattaattatagttttccattcttacttattttaattgaaaatctatttttgtctcttaaaagtccaaacaatacattagtctagccctcctctgcttttttttttctatctcgtgaagagaagaaaacgatacgtaaatcccttcgaaaactaatgtacgttgtacgacttattgttttcataaaaaaaaaaaaaaa

SEQ ID NO: 10 - DNA, 1240 bp, Arabidopsis thaliana
  G591
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 11 - DNA, 1179 bp, Arabidopsis thaliana
  G525
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaaaaaaaaaaaaaaaaaaa

SEQ ID NO: 12 - DNA, 890 bp, Arabidopsis thaliana
  G545
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 13 - DNA, 1126 bp, Arabidopsis thaliana
  G865
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaaaaaaaaaa

SEQ ID NO: 14 - DNA, 1152 bp, Arabidopsis thaliana
  G881
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaaaaaaaaaaaaaaaaaa

SEQ ID NO: 15 - DNA, 1276 bp, Arabidopsis thaliana
  G896
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 16 - DNA, 726 bp, Arabidopsis thaliana
  G378
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 17 - DNA, 1370 bp, Arabidopsis thaliana
  G569
gtcgacccacgcgtccgggtttttcttttatcctcttatcgctaatctggagctctatatagactataaagggtttttgattgattcgggagctcgagatttgacttcttttagctgattcggcaagtttgtatctagaaaggatcgattggtgaggtcaatagtggttggtgggttttagtaatggaagacggtgagcttgatttctccaatcaggaagtgttttcgagttcggagatgggtgaattaccacctagcaattgttcgatggatagtttctttgatgggcttttaatggatactaatgctgcttgtacccacactcacacctgtaaccccactggaccagagaacactcatactcacacgtgcttccatgtccacaccaagattctcccggatgagagcgatgaaaaagtttctactgatgatacagctgagtcttgtgggaagaagggtgaaaagagacctttgggaaaccgggaagcggttagaaagtatagagagaagaagaaggctaaagctgcttctttggaggatgaggttgcaaggcttagggcggtgaatcagcagctggtgaagaggttgcaaaatcaggctaccttggaagctgaggtttcgaggcttaagtgtttgcttgtggatttgagaggaagaatagatggagagattggatcttttccttatcagaaacctatggctgcaaatattccttctttctcgcacatgatgaatccttgtaatgtacaatgtgatgatgaagtttattgccctcagaatgtgtttggagtgaatagccaagaaggtgcctcgatcaatgaccaagggttaagtggttgtgattttgatcagctacaatgcatggctaatcagaacttaaatggaaatggaaacggatcattcagcaacgtcaatacatctgtctcgaataagagaaaaggtgggcatcgtgcatcaagagcagtttgaagcatcatcaagcttgtactatctatttccaccagcatagatattgtattccaaataagttgtagagttcagctgcaggatcagcttcgctcagctttgaggggttggtggtgtggtctttctttgtggcacgagtgagatctatggacagaacccagatttagtagtagtagaggcaggatttcgacttccactaaccatcatgttgcttggtgaagaacaaggtatgcccatgaagcacactgttttgtacattgagcttgaggggctgtctctgatctagccttactgtaacattgcaacgttctcacaattgtgatcccaagttgctttgttgacttaaatgtgataatatagcttaacttttacttgaaaaaaaaaaaaaaaaaaaaaaaaaaaaa

SEQ ID NO: 18 - DNA, 1638 bp, Arabidopsis thaliana
  G558
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 19 - DNA, 913 bp, Arabidopsis thaliana
  G22
agaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttgttgtaaaaaaaaaaaaaaaaaa

SEQ ID NO: 20 - DNA, 584 bp, Arabidopsis thaliana
  G225
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 21 - DNA, 407 bp, Arabidopsis thaliana
  G226
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 22 - DNA, 1547 bp, Arabidopsis thaliana
  G256
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 23 - DNA, 2405 bp, Arabidopsis thaliana
  G419
aagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagttagataaaaaccaaattagatatttatatataccgttgtctgattggattggaggattggtggacaaggagatattattaatgtatgagttagttggttcgtcaaaaaaaaaaaaaaaaaa

SEQ ID NO: 24 - DNA, 989 bp, Arabidopsis thaliana
  G464
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatggtgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaacggttaaacctttaaggcttttagatggatcatcagactttgtactcacttatgaagataaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttg

SEQ ID NO: 25 - DNA, 1065 bp, Arabidopsis thaliana
  G482
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 26 - DNA, 1409 bp, Arabidopsis thaliana
  G502
ttgatgccgctcaatcccactatccttcgcaaggacccttcctctatataaggaagttcatttcatttggagaggacacgctgacaagctgactctagcagatctgggaccgtcgacccacgcgtccgaattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 27 - DNA, 1481 bp, Arabidopsis thaliana
  G526
cgacccacgcgtccgagattctctcccagctagctttctcaattcatttttctttcttcatcttcttcttgtgtgatctctctttccaaataagcttatcattcttacaaaaatatttctgggtttctgatattgttcttgttctcttgaatctttattacttgaaaaacatataaagtgatggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaaagagggcaaagatgggggagaaagagttctacttcttctgtcaaagggacaggaagtatccgactgggatgaggacgaaccgtgcgacggagtcaggatactggaaagccaccgggaaggataaggagatcttcaaaggcaaaggttgtctcgttgggatgaagaaaacacttgtgttttatagaggaagagctccaaaaggtgaaaagactaattgggtcatgcatgaatatcgtcttgaaggcaaatattcgtattacaatctcccaaaatctgcaagggacgaatgggtcgtgtgtagggtttttcacaagaacaatccttctaccacaacccaaccaatgacgagaatacccgttgaagatttcacaaggatggattctctagagaacattgatcatctcctagacttctcatctcttcctcctctcatagacccgagtttcatgagtcaaaccgaacaaccaaacttcaaacccatcaaccctccaacttacgatatctcatcaccaatccaaccccatcatttcaattcttaccaatcaatctttaaccaccaggtttttggttctgcttcgggctctacgtacaacaacaacaacgagatgatcaagatggagcaatcacttgttagtgtatctcaagaaacatgcctaagctcagatgtgaacgcgaacatgactacaaccacggaggtatcttcgggtcctgtaatgaaacaagaaatggggatgatgggaatggtgaatggtagcaagtcgtatgaagatctatgtgacttgaggggggacttgtgggacttctaattaatcatttgactgtggtgaaagagtatatttgttgggatttaaatcatgttagttaatacatatacatataggatttactagaggcttaatcctagttaactattttcacttcattgatattatttaattagttgattgtttaattagtttatactttatagtgtggttaaaaaagaaaagaaaggattgtgataatttgggattttagtgcataagttatatctcaatgtaaactgtatttgtatccaaaaaaaaaaaaaaaaaaaaaaaaaaaaaaaaaaaaaaaaaaa

SEQ ID NO: 28 - DNA, 1413 bp, Arabidopsis thaliana
  G561
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 29 - DNA, 1087 bp, Arabidopsis thaliana
  G664
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 30 - DNA, 228 bp, Arabidopsis thaliana
  G682
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattga

SEQ ID NO: 31 - DNA, 480 bp, Arabidopsis thaliana
  G911
atgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaa

SEQ ID NO: 32 - DNA, 1221 bp, Arabidopsis thaliana
  G964
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 33 - DNA, 1249 bp, Arabidopsis thaliana
  G394
gaaattcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttacttattagttatttaattctttttgttggttttttttttgtttcttaaatcaaattaggaattagttagaagataaatcccagggaaaaaatattacgttgaaattggggggaaatggggtatagtctttatagataagactcttcaacgattccactttatttttcggtgggattgttggttgatgaagaaaaaaaaatagtttgtaattacaggtttaaatatgtagagaaaaaatgacgaatatgtattatcttgtttttttttccttcgaatatgtattacggtaatataaatttgcttgtaaaaataataaatatattatttg

SEQ ID NO: 34 - DNA, 1008 bp, Arabidopsis thaliana
  G489
tggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcgcggccgctctagacaggcctcgtaccggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtccatttgttgtgcttgtaatttactgtgttttttattcggttttcgctatcgaactgtgaaatggaaatggatggagaagagttaatgaatgatatggccttttgttcattctcaaattaa

SEQ ID NO: 35 - DNA, 2240 bp, Arabidopsis thaliana
  G214
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 36 - DNA, 1209 bp, Arabidopsis thaliana
  G229
ttgtggtcagtggaataaacacatataaccgccggagaaaatgggaagagcgccatgttgcgagaaggtcggtatcaagagagggcggtggacggcggaggaggaccagattctctccaactacattcaatccaatggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatggcgaacgcttcttcagcgccaccgccgccgcaggcaaaacgcagacttgggagaacgagtaggtccgctatgaaaccaaaaatccgcagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtggtggggagttgcataacataagagactctgaaggagccagagggttctcggatacttggaaccaagggaatctcgactgtcttcttcagtcttgtccatctgtggagtcgtttctcaactacgaccaccaagttaacgacgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatc

SEQ ID NO: 37 - DNA, 1046 bp, Arabidopsis thaliana
  G233
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 38 - DNA, 1033 bp, Arabidopsis thaliana
  G663
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 39 - DNA, 1640 bp, Arabidopsis thaliana
  G776
tgcaattgaaggtgaggtttggtgaaagggaaattgagaaaaccctagaacaagtacggtctctattttgctttaatgggtcgcgaatctgtggctgttgtgactgcgccgccctcggcgactgctccgggtactgcttcggtggcgacctcgcttgctcctggcttccgatttcatccgactgatgaggaactcgtgagctattacttgaagaggaaggttctgggccaacctgtacgcttcgatgcgattggagaggtcgatatatacaagcatgagccctgggatttagcagtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtgcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttcttttaaaaaaaaaaaaaaaaaaaa

SEQ ID NO: 40 - DNA, 1389 bp, Arabidopsis thaliana
  G778
tctcaataacacaaaaccttttaaactagtaaaatacacagattttaggatgagccaatgtgttccaaactgtcacatcgatgatactccggcagcagccaccaccaccgtccgctccaccacagccgcagacatccccatattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacagatggaggacgaagaagagaagaaagccggaggaaaatcatcagtttcaaccaagagaagcagagctgctgctattcataaccaatccgaacgtaagaggagagataaaatcaatcaaaggatgaagactttgcaaaaactggttcccaattccagcaagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcagccaacgacgatggaagcgtatagcaggatggctacattatatcagcaaatgcaacaacaacttcctcctccttcgaatccaaaatgattattactcaaacacctctatatagtttacgtctatatatgtgttagtcacatacatacatatatatattccatcataattatttatttatatgtataggcttctcatgaattatgatattatacgtattacgtaaaaaa

SEQ ID NO: 41 - DNA, 1195 bp, Arabidopsis thaliana
  G883
ctctctcgtcttcgtcttcttcttcttcaacgttcctctccaaaatcctcagaccaagaaatcatcatggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgtcgcagcctgttaactcttccggaaaaccaccgttggctggtcatccttacagaaagagatgtctcgagcatgagcactcagagagtttctccggaaaagtctccggctccgcctacggaaagtgccattgcaagaaaaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttgacttttttttgtactatttgttttttgattttttgagtactttagatggattgaaatttgtaaatttttttattaagaaatcaatttaaatagagaaaaattagtggtggtgcaaaaaaaaaaaaaaaaaaaaaaaaaaaaaaaaaaaaaaaaaa

SEQ ID NO: 42 - DNA, 1755 bp, Arabidopsis thaliana
  G938
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 43 - DNA, 1161 bp, Arabidopsis thaliana
  G1328
aattcaatcactatatttttttaaaaacatttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatcattgtatttgttatatagattttgttacatatccaaaatccaaaatactatagttttaaaataaaaaaaaaaaaaaaaaa

SEQ ID NO: 44 - DNA, 2162 bp, Arabidopsis thaliana
  G584
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 45 - DNA, 1056 bp, Arabidopsis thaliana
  G668
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 46 - DNA, 2007 bp, Arabidopsis thaliana
  G727
cttcttctccttctctgatcgttcgttttctggacgagagagatggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagagagcagagagcgcattgtctctgcttcggaagaacaaagaatggttttgatattgtcattagtgatgttcatatgcctgacatggatggtttcaagctccttgaacacgttggtttagagatggatttacctgttatcaatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgattggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttgattattactcgaatacagtgcactctaaaac

SEQ ID NO: 47 - DNA, 834 bp, Arabidopsis thaliana
  G732
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 48 - DNA, 1246 bp, Arabidopsis thaliana
  G9
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 49 - DNA, 1379 bp, Arabidopsis thaliana
  G428
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 50 - DNA, 1166 bp, Arabidopsis thaliana
  G1269
aacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 51 - DNA, 2031 bp, Arabidopsis thaliana
  G1038
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 52 - DNA, 2821 bp, Arabidopsis thaliana
  G438
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 53 - DNA, 1888 bp, Arabidopsis thaliana
  G571
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 54 - DNA, 1707 bp, Arabidopsis thaliana
  G748
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 55 - DNA, 1149 bp, Arabidopsis thaliana
  G431
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctctttctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttggacaatcctttcccaatggatcacatctcctccaccatgctttga

SEQ ID NO: 56 - DNA, 1136 bp, Arabidopsis thaliana
  G187
tagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaa

SEQ ID NO: 57 - DNA, 2580 bp, Arabidopsis thaliana
  G470
atggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgctttggaccctgaggctgctctttacagagagctatggcacgcttgtgctggtccgcttgtgacggttcctagacaagacgaccgagtcttctattttcctcaaggacacatcgagcaggtggaggcttcgacgaaccaggcggcagaacaacagatgcctctctatgatcttccgtcaaagcttctctgtcgagttattaatgtagatttaaaggcagaggcagatacagatgaagtttatgcgcagattactcttcttcctgaggctaatcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggatatgtctcgacagcctcccactcaagagttagttgcaaaggatttgcatgcaaatgagtggcgattcagacatatattccggggtcaaccacggaggcatttgctacagagtgggtggagtgtgtttgttagctccaaaaggctagttgcaggcgatgcgtttatatttctaaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggacgagcccatctgagtttattgttccgttcgatcagtatatggagtctgttaagaataactactctattggcatgagattcaaaatgagatttgaaggcgaagaggctcctgagcagaggtttactggcacaatcgttgggattgaagagtctgatcctactaggtggccaaaatcaaagtggagatccctcaaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 58 - DNA, 1519 bp, Arabidopsis thaliana
  G615
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 59 - DNA, 974 bp, Arabidopsis thaliana
  G1073
ccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 60 - DNA, 1084 bp, Arabidopsis thaliana
  G26
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 61 - DNA, 1440 bp, Arabidopsis thaliana
  G38
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 62 - DNA, 909 bp, Arabidopsis thaliana
  G43
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 63 - DNA, 1107 bp, Arabidopsis thaliana
  G207
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 64 - DNA, 1391 bp, Arabidopsis thaliana
  G254
cgatttcgagctctatggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacttcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatagagatagaataaaacaataatgtaccttatgtgagatcaagagacaatcatccaaggtctgtatgcattgcttggatttaggcctcgtgttctcactacaggagcagaaccaatcgcaaagactcttagatggctactgagttgtggtttttatgtctctgtaagtcgcggtggagcacacgtgtttgtcctgtcttgtgtatgtgtgtatagataatacaaggttttgcagagtaaggtcacagttagctgcaagtgagtttggatcaatcttaagattaaaaccctgagagtgagtgtccaaagagactgtgtaatattggtttggcggtcagcagaagagttttgaagtgcacatccagttagtgataacacggttgaagaaaaggtaaggttacaagtttagttttgaataattgtatactcaaaaaatatgaatgtataaagaataatcacttgagtcgcctta

SEQ ID NO: 65 - DNA, 1121 bp, Arabidopsis thaliana
  G263
tttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaataaaacaaaaaaaaaaa

SEQ ID NO: 66 - DNA, 1951 bp, Arabidopsis thaliana
  G308
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 67 - DNA, 768 bp, Arabidopsis thaliana
  G536
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 68 - DNA, 2526 bp, Arabidopsis thaliana
  G680
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 69 - DNA, 1281 bp, Arabidopsis thaliana
  G867
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 70 - DNA, 724 bp, Arabidopsis thaliana
  G912
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 71 - DNA, 1082 bp, Arabidopsis thaliana
  G996
cgatcgatcttgaattgattctttgtagtattttatttacatatatatatagatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagcttcagcctcagcaacatgcatatggccatatataaatcttcttgtatattataa

SEQ ID NO: 72 - DNA, 1606 bp, Arabidopsis thaliana
  G1068
gagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattgagctctcttactctctcatcttcttctcctttactatttctcttaaatttagctttggttttagataaatagagagagagagacatgttaagtaggtttcaaattcaatcttgtttagtttgtttcttagtagtttcttttgattgtgatgatcataaagacttgttctttttctcctatattcaacgaattatccactttaa

SEQ ID NO: 73 - DNA, 1630 bp, Arabidopsis thaliana
  G1337
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 74 - DNA, 916 bp, Arabidopsis thaliana
  G231
ttccatatctcttccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctggcttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaacgc

SEQ ID NO: 75 - DNA, 2371 bp, Arabidopsis thaliana
  G274
gacattattttaagtgtgttctctctctgtcacactcacaaagctttatactttctggctactgcaagctcatcagtgaaaagagcttaaaccagagagatctgataagagaaattttagagtctctctgcttcaacaagatctacatcgaccaggagattagaaagaatcatgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 76 - DNA, 1764 bp, Arabidopsis thaliana
  G307
atgaagagagatcatcaccaattccaaggtcgattgtccaaccacgggacttcttcttcttcatcatcaatctctaaagataagatgatgatggtgaaaaaagaagaagacggtggaggtaacatggacgacgagcttctcgctgttttaggttacaaagttaggtcatcggagatggcggaggttgctttgaaactcgaacaattagagacgatgatgagtaatgttcaagaagatggtttatctcatctcgcgacggatactgttcattataatccgtcggagctttattcttggcttgataatatgctctctgagcttaatcctcctcctcttccggcgagttctaacggtttagatccggttcttccttcgccggagatttgtggttttccggcttcggattatgaccttaaagtcattcccggaaacgcgatttatcagtttccggcgattgattcttcgtcttcgtcgaataatcagaacaagcgtttgaaatcatgctcgagtcctgattctatggttacatcgacttcgacgggtacgcagattggtggagtcataggaacgacggtgacgacaaccaccacgacaacgacggcggcggctgagtcaactcgttctgttatcctggttgactcgcaagagaacggtgttcgtttagtccacgcgcttatggcttgtgcagaagcaatccagcagaacaatttgactctagcggaagctcttgtgaagcaaatcggatgcttagctgtgtctcaagccggagctatgagaaaagtggctacttacttcgccgaagctttagctcggcggatctaccgtctctctccgccgcagaatcagatcgatcattgtctctccgatactcttcagatgcacttttacgagacttgtccttatcttaaattcgctcacttcacggcgaaccaagcgattctcgaagcttttgaaggtaagaagagagtacacgtcattgatttctcgatgaaccaaggtcttcaatggcctgcgcttatgcaagctcttgcgcttcgagaaggaggtcctccaactttccggttaaccggaattggtccaccggcgccggataattctgatcatcttcatgaagttggttgtaaattagctcagcttgcggaggcgattcacgtagaattcgaataccgtggattcgttgctaacagcttagccgatctcgatgcttcgatgcttgagcttagaccgagcgatacggaagctgttgcggtgaactctgtttttgagctacataagctcttaggtcgtcccggtgggatagagaaagttctcggcgttgtgaaacagattaaaccggtgattttcacggtggttgagcaagaatcgaaccataacggaccggttttcttagaccggtttactgaatcgttacattattattcgactctgtttgattcgttggaaggagttccgaatagtcaagacaaagtcatgtctgaagtttacttagggaaacagatttgtaatctggtggcttgtgaaggtcctgacagagtcgagagacacgaaacgttgagtcaatggggaaaccggtttggttcgtccggtttagcgccggcacatcttgggtctaacgcgtttaagcaagcgagtatgcttttgtctgtgtttaatagtggccaaggttatcgtgtggaggagagtaatggatgtttgatgttgggttggcacactcgcccactcattaccacctccgcttggaaactctcgacggcggcgcactga

SEQ ID NO: 77 - DNA, 825 bp, Arabidopsis thaliana
  G346
atggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttggaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaccaccaccactccaacaataatgagctgttgcgttggttttaaagcgccggctaaagcgagaagcaagcgtcgtcgtacaggacgccgtgatttacgagttttgtggacaggaaacgagcaaggaggaatacagaagaagaagacgatgactgtggcggcggctgcgttgattatgggaaggaagtgtcaacactgtggagcggagaagactccgcaatggagggcaggaccagcggggcctaagactctgtgtaacgcttgtggcgtgaggtataagtccgggaggctagttccggagtatcgtccagcgaacagtccaactttcacggcggagttacattcgaattctcaccggaagattgtagagatgaggaagcagtatcagtccggtgacggtgacggtgatcggaaagattgtggataa

SEQ ID NO: 78 - DNA, 1226 bp, Arabidopsis thaliana
  G598
gtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagtataatgtaggttcattcaacaatcgtctaaatgaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcaaa

SEQ ID NO: 79 - DNA, 1263 bp, Arabidopsis thaliana
  G605
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 80 - DNA, 1057 bp, Arabidopsis thaliana
  G777
gtggctctctctttatctttcttggagtttagttagagattttaacgttgcaaatggatcaaccaatgaaaccaaaaacttgctctgaatctgattttgctgatgattcctctgcttcttcttcttcttcttcgggacaaaatctcagaggagctgagatggtggtggaagtgaagaaggaagcagtttgttcccagaaagcagagcgagagaagcttcgtagagataagcttaaggaacagtttcttgagcttggaaatgcacttgatccgaataggcctaagagtgacaaagcctcagttctcactgatacaatacaaatgctcaaggatgtaatgaaccaagttgatagactaaaagctgagtatgaaacactatctcaagagtctcgtgagctaattcaagagaagagtgagctgagagaggagaaagcgactttaaagtctgatatcgagattcttaatgctcaatatcagcatagaatcaaaaccatggttccatgggtacctcattacagttatcatatccccttcgtagccataactcagggtcagtccagttttataccttattcagcctctgtcaatcctctaaccgaacaacaagcatcggttcagcagcattcttcttcttctgccgatgcttcaatgaaacaagattccaaaatcaagccgttagatttggatctgatgatgaacagtaaccattcaggtcaaggaaatgatcaaaaagatgatgttcgtttaaagctcgagcttaaaatccatgcctcttctttagctcaacaggatgtttctggaaaagagaagaaagtaagcttgacaaccactgcaagctcatcgaatagttactcattatctcaagctgttcaagatagttcccccggtaccgtaaatgacatgttgaagccataaaccaataaacatattcccctgaacttgtgtttaataccgtgattgagaaggtaccatgattaaacttgttgtagattatccacatgattaacgatgtattcttatcacaagcaaataaaacacaaaagcatttgcttaaaaaa

SEQ ID NO: 81 - DNA, 1322 bp, Arabidopsis thaliana
  G1133
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaa

SEQ ID NO: 82 - DNA, 859 bp, Arabidopsis thaliana
  G1266
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 83 - DNA, 1137 bp, Arabidopsis thaliana
  G1324
cgaaaacaccacaaaccaaatatcattaagtaattaggaaacttaaactaagtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgttaaatttgtatcttctttgttgcgagtacttactaagtcattggataaatatttataatgatagtttcttgtacaaaaaaaaaaa

SEQ ID NO: 84 - DNA, 768 bp, Arabidopsis thaliana
  G975
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 85 - DNA, 883 bp, Arabidopsis thaliana
  G859
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 86 - DNA, 1196 bp, Arabidopsis thaliana
  G859
aaaaaggagagagagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaaggttagcacaaagacacttttatctccctcttcttctgatgaaaaatacttttttttttcttttcttttggcgaattatgaatacagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacgcatgtcaaagatcattgatcgttatgaaatacatcatgctgatgaacttaaagccttagatcttgcagaaaaaattcggaattatcttccacacaaggagttactagaaatagtccaaagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggtaaaccaaaaaaaaaaaaaaaaaaaaaa

SEQ ID NO: 87 - DNA, 1059 bp, Arabidopsis thaliana
  G859
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 88 - DNA, 818 bp, Arabidopsis thaliana
  G1843
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 89 - DNA, 834 bp, Arabidopsis thaliana
  G1844
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 90 - DNA, 1134 bp, Arabidopsis thaliana
  G861
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 91 - DNA, 1171 bp, Arabidopsis thaliana
  G192
cttttttctcttctctcctcagagattcgaagctttttgtctcccctgagtaaccaaattcaatggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatgattagattacgacggcttagaatactcttattaggacagatttataggattaaggaattattctcggagcatatgtaaaaataggataaaagaaaatgttctttgttactttttttcgggttttcttcctattgtttctaaacatcttagaaaaaatttaattgtatattccttaagctcgatacatcttgttttaaaaaaaaaaaaaaaaaa

SEQ ID NO: 92 - DNA, 1139 bp, Arabidopsis thaliana
  G234
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 93 - DNA, 922 bp, Arabidopsis thaliana
  G361
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 94 - DNA, 420 bp, Arabidopsis thaliana
  G486
atgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttga

SEQ ID NO: 95 - DNA, 1095 bp, Arabidopsis thaliana
  G994
tgtatatatagttagttagttgagataaacttggttaccacttttgtgtggtctttctttttctttttctccattttccatttatcgaccccttgggtgtagctaattactttcgcgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagtataaagaatcaaagttatgaaacattgtaatttgatttccaaattaatctaatgaataaatgtgctttgcaaaaaaaaaaaaaaaaaaaaaaa

SEQ ID NO: 96 - DNA, 965 bp, Arabidopsis thaliana
  G1335
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 97 - DNA, 1554 bp, Arabidopsis thaliana
  G562
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 98 - DNA, 513 bp, Arabidopsis thaliana
  G736
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 99 - DNA, 1281 bp, Arabidopsis thaliana
  G1435
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 100 - DNA, 837 bp, Arabidopsis thaliana
  G180
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttcatttctgttcaaacaaaaaaaaaaaaaaa

SEQ ID NO: 101 - DNA, 1413 bp, Arabidopsis thaliana
  G592
aagctattaagatttggttttctacaaatttgttcttcctgaaacgtcacgagacagagcttacaagaagagaaaacagaggaaatttcgttgcattttttttacatattgattcgattaatggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatagggcgcaacaaagtgtgtagtagataggactaaaaagcagggagaaggacaagaaagaaacaatgtcatgtctgaatattttttagccgaaacagaccaaattgtctatgtaagctctcgagaaaagcatctgcttccaacaaaattctaagtaataaaatagtactcgatttgttcttatttcattattacaatgcagaatctactaatcaaa

SEQ ID NO: 102 - DNA, 764 bp, Arabidopsis thaliana
  G208
cttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaaatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaataatttgtcaaaaaaatcccaaaaaatgggtttgttaaa

SEQ ID NO: 103 - DNA, 897 bp, Arabidopsis thaliana
  G658
ccacgcgtccgctcacatgaacaaaggagcttggactaaagaagaagatcagcttcttgttgattacatccgtaaacacggtgaaggttgctggcgatctctccctcgcgccgctggattacaaagatgtggtaagagttgtagattgagatggatgaattatctaagaccagatctcaaaagaggcaattttactgaagaagaagatgaactcatcatcaagctccatagcttgctcggtaacaaatggtctttaatagctgggagattaccaggaagaacagataacgagatcaagaactattggaacactcatatcaagaggaagcttctcagccgtgggattgatccaaactctcaccgtctgatcaacgaatccgtcgtgtctccgtcgtctcttcaaaacgatgtcgttgagactatacatcttgatttctctggaccggttaaaccggaaccggtgcgtgaagagattggtatggttaataattgtgagagtagtggaacgacgtcggagaaggattatgggaacgaggaagattgggtgttgaatttggaactctctgttggaccgagttatcggtacgagtcgactcggaaagtgagtgttgttgactcggctgagtcgactcgacggtggggttccgagttgtttggagctcatgagagtgatgcggtgtgtttgtgttgtcggattgggttgtttcgtaatgagtcgtgtcggaattgtcgggtttctgatgttagaactcattagagagtcaatcgagaattctttaggaatctttttatatatttagatcgtcaattgtgttttttttttgttcacatttgttatgtaacatcaagtaagaaactagcataattatttgatggcaaagccaaaagattgtgctc

SEQ ID NO: 104 - DNA, 1274 bp, Arabidopsis thaliana
  G1334
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 105 - DNA, 881 bp, Arabidopsis thaliana
  G27
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 106 - DNA, 1212 bp, Arabidopsis thaliana
  G740
cttcttcaacttttttttttaacgatggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatcccttttttgttataactattacaagtttttagctttatttgatatggatgctctctccttttcttctatctgtttctggaaattttgacctcatcatattacttatgtcatccaaa

SEQ ID NO: 107 - DNA, 1407 bp, Arabidopsis thaliana
  G559
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 108 - DNA, 531 bp, Arabidopsis thaliana
  G1093
atgggttatccggtggggtacactgagctcctcctcccaagaatcttccttcacttactctctctcttaggcttaatacgaacactcatagacacgggttttcggatattgggtctacccgactttctcgaatccgacccggtttcatcgtcatcgtcatggctggaaccaccgtatatgtccacggcggcgcatcatcaccaagaaagctcatttttcttcccagtggcggcgaggctagctggagaaatcttgcccgtcatcagattctcggagctaactcgacccggattcggatccggatccgattgctgcgcggtgtgcctccacgagttcgagaacgatgacgagatccgacggctgacgaattgtcaacacatatttcaccggagctgtttagaccgttggatgatgggttataatcagatgacgtgtccactttgtagaacgccgtttatttctgatgagttacaagttgcttttaaccaacgagtttggtctgaatctgaacttctcgcagaatcaaattag

SEQ ID NO: 109 - DNA, 1221 bp, Arabidopsis thaliana
  G725
cctctttcagagagagaaagagagtcagagagagagagagagagaatgttccatgctaagaaaccttcaagtatgaatggttcatatgagaacagagctatgtgcgttcaaggcgattcaggccttgtcctcaccaccgaccctaaaccgcgtttgcgttggaccgtcgaactccacgagcgttttgtggacgccgtcgctcagctcggcggccccgacaaagcgaccccaaagacgattatgagagttatgggtgtgaagggtcttactctttaccacctaaagagccatcttcagaaattcaggcttggaaagcagccgcacaaggagtacggagatcactccacaaaggaaggttcaagagcttctgccatggatattcagcgcaacgtagcttcttcttctggcatgatgagtcgcaacatgaatgagatgcaaatggaagtgcagagaaggttgcatgaacagctagaggtgcaaagacatctgcaactgaggattgaagcacaaggaaagtacatgcaatctatcttggagagagcttgccaaaccctagccggtgagaacatggcagccgccaccgcagcagccgccgtcggaggaggatacaagggtaatctgggaagttcgagtctttcagcagcggtgggcccacctcctcatcctcttagtttcccgccgtttcaagacctaaacatctatggaaacacaaccgaccaagtcctcgaccatcacaacttccatcatcaaaacatagagaaccatttcacgggtaacaatgctgcagacaccaacatttacttggggaagaagcgacctaatcctaattttggtaacgatgtaaggaaaggactattgatgtggtctgatcaagatcacgatctttccgcaaaccaatcgatcgatgatgagcatagaattcagatacagatggctacacatgtctccacggatttggattctttgtcggagatctacgaaaggaaatcaggtttatcaggtgatgaagggaataatggtgggaaattactggaaaggccatcgcctaggagatcaccattgagtcctatgatgaaccctaatggtggattaatacaaggaagaaactcgccatttgggtgatacaatttattaatttttatctatgagtgatgcatgggaatgtaagaacgagatatatatgttttgtcattgtgagtttgacgtagggtttagagaaaa

SEQ ID NO: 110 - protein, 367 aa, Arabidopsis thaliana
  G896
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 111 - DNA, 1577 bp, Arabidopsis thaliana
  G4 cDNA Sequence
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgcattggtatctcatgagccttctcttccatagagagtttctcttttaattttgtcgaaataaaaaaggtgtgatgaagtaaatagaggtataataatatctatctattaagtcttgttttgttctttcatttttgtatttcttttctatttaaaagacagtttattagtcttctgagctctctttttgatctttgttatagcgtatcatcaccctcgaaagtgtaatgttttgtacccccaaacttgtttagcattataataaagtctctttg

SEQ ID NO: 112 - protein, 375 aa, Arabidopsis thaliana
  G4 Amino Acid Sequence
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 113 - DNA, 1385 bp, Arabidopsis thaliana
  G4 Genomic Sequence
atgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactggtatatatttgggtttgattcgaatctcaacttttatttgaattggaaagctcatgaaatttttagatctttaggttttcagaggcttttcttagtttatagcttagtctttggaattggttgatctcactggtcttgtaaccatctgctgttactatgttgattatataccagcttaccgtccttagctcctgaagggatgcagttttgtttgttctattcagcttatgattgatattgtgtgtgtttggctacagtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttga

SEQ ID NO: 114 - DNA, 1385 bp, Arabidopsis thaliana
  G4 DNA sequence used for BLAST
tcaaaagtctccttccagcatgaaattgatctcatctaagctccatagctccactgggttttcctcttcctgagtcacagcaccagcatctgcgccaagcatggcttccacttctagtggggtgtcccacaaggcgttgtcaaggtatgccatcagatcgtctgactcatcagagtttggtttgagcttcttggctgcattggtttcttcaacaaatgatgcttcgttgttattgacaagcattgaagagatctcgggtgttttagggccgtgatcactccacccgaactcagaacagtcgaaggagttactgccctgatcggaactgaaatactggtatccattgttacctccagcatcgaacgagtttgttaacccaaactgattgttgtacatctgaggcttctcttccatgaaactcatatcaccaaaagagttgtcaaaggagttgttgcagtactgctgactcagatgtgttggctgctgaaccaaagttacgcttttgtttggtttagccactgatttctgaagattattagtcttagcactaggacgtttctgggatacgacgctagggttcttctcctcgggaaaattcaccttagctttcgtgccacggattctgcgtgctgcagcatcataagctcttgctgcttcctcagcagtgtcgaatgttccaagccattctcgggagccttttctcggatcacggatctccgcagcccattttccccaaggacgctgcctaatccctcggtattgattcttcctcttcctcttagaagatttctcagcttgctcagcggactctacagttttcttggcatatgctgaacctactgtagccaaacacacacaatatcaatcataagctgaatagaacaaacaaaactgcatcccttcaggagctaaggacggtaagctggtatataatcaacatagtaacagcagatggttacaagaccagtgagatcaaccaattccaaagactaagctataaactaagaaaagcctctgaaaacctaaagatctaaaaatttcatgagctttccaattcaaataaaagttgagattcgaatcaaacccaaatatataccagtggagacgaaagcggaagctacgggcttagtagttgcggtgaagacgaaaggcttaacattgacgaagacatcatcatcgtcttcgcagtcaaaagccgagtcatccttaaacccttggaaatcagcttcgaaatcatcgtcaagatcgaagaaatcggatcgcttattcgatctcttctttgaagctttcactttgtttttcagatccggccagataaactcgttagtgacgcggagggacctcggcggaggtatgaaatcggagattatagctcctccacacat

SEQ ID NO: 115 - DNA, 1699 bp, Arabidopsis thaliana
  G5 cDNA Sequence
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 116 - protein, 334 aa, Arabidopsis thaliana
  G5 Amino Acid Sequence
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 117 - DNA, 1005 bp, Arabidopsis thaliana
  G5 Genomic Sequence
atggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatctcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttag

SEQ ID NO: 118 - DNA, 1005 bp, Arabidopsis thaliana; identical to SEQ ID NO: 117
  G5 DNA sequence used for BLAST

SEQ ID NO: 119 - DNA, 1023 bp, Arabidopsis thaliana
  G6 cDNA Sequence
tatctatccgagaatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctgagcttttaacggtgtcgtttcaattcgaagcgcatgcgtttcttcttctttttgagctgtgaaaattcgttttctcatagtttttcctctctctctctctcagtctaaatttattaccagtttttagaaagaaaaaacagattaaatctgagagagaaaaatataattttagctgacatggatcgttatgtacatattattacataaccggagatctgaacttttgttgtgtgcttttaattttttgcgacttggtttcaccccatgttgtttctctattttttttactactttttttttttttgttcttccaaattttcaatcaataatttggtaatcttc

SEQ ID NO: 120 - protein, 222 aa, Arabidopsis thaliana
  G6 Amino Acid Sequence
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 121 - DNA, 669 bp, Arabidopsis thaliana
  G6 Genomic Sequence
atggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctga

SEQ ID NO: 122 - DNA, 669 bp, Arabidopsis thaliana; identical to SEQ ID NO: 121
  G6 DNA sequence used for BLAST

SEQ ID NO: 123 - DNA, 859 bp, Arabidopsis thaliana
  G7 cDNA Sequence
gtgactctaacgaagaaaccggcaatggccagtatcactacaatgccgaagaaataacaagaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgatctaccaattttttctctcccaatacaacttcagtctgattattgccttcttagatatgtcttcgaatgttatgactatacatgggtgtatataaaatttgtgatcaaagtcttgt

SEQ ID NO: 124 - protein, 192 aa, Arabidopsis thaliana
  G7 Amino Acid Sequence
MVSMLTNVVSGETEPSASATWTMGHKREREEFSLPPQPLITGSAVTKECESSMSLERPKKYRGVRQRPWGKWAAEIRDPHKATRVWLGTFETAEAAARAYDAAALRFRGSKAKLNFPENVGTQTIQRNSHFLQNSMQPSLTYIDQCPTLLSYSRCMEQQQPLVGMLQPTEEENHFFEKPWTEYDQYNYSSFG

SEQ ID NO: 125 - DNA, 675 bp, Arabidopsis thaliana
  G7 Genomic Sequence
atggtgtctatgctgactaatgttgtctctggtgagaccgaaccctcggcatctgcgacatggacgatgggtcataagagagaaagagaagagttttctttgcctcctcaaccattgattaccggttcagctggtatgcatgtttttctaaatcgaatttttttttgttgagaacactatactaaccaataaaacattctttaaccaaaaacaaaaatcaataaaacagtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactctatgcaaccttctctgacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaa

SEQ ID NO: 126 - DNA, 675 bp, Arabidopsis thaliana; identical to SEQ ID NO: 125
  G7 DNA sequence used for BLAST

SEQ ID NO: 127 - DNA, 1246 bp, Arabidopsis thaliana; identical to SEQ ID NO: 48
  G9 cDNA Sequence

SEQ ID NO: 128 - protein, 352 aa, Arabidopsis thaliana
  G9 Amino Acid Sequence
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTCEVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 129 - DNA, 1059 bp, Arabidopsis thaliana
  G9 DNA sequence used for BLAST
tcacaaagcattgattatcgcctgcttcttggaacaccgtaacgcaaacatatcatcaacatctcgagatctctttccaccgcaaacggccacgacgtcgtttggcttcacggtggtcacattaaagatatcaactccgaaaagccgaaccaccacctgaaccgggttttctctcggaccagaccgaactttccaatcaatatataactgccgctctagtccggtcgatctctcgaaagtaacaacatcaccggctcgaagattcttctccttgacgaatcgactccatcccttggtcaacacgtaactttgactactgttccagtatgagtaacggaacctccacactttaccgttaacgtcttcgaagttgatcaaaactcctttagtcactgccggtgacggtgacggtaacggaaagtgtttctcggcgtgttgtttaggtatcacgagacggtttagcttcccaacgtcgctaggtgtaacagccttctcgaaaagaacttcacgcgtctttaaaactttgtcgttttgagtagtactcgatccgttacgttttccgttagcgtcgacggagagaaacaactgccgtttattgttctgttcaagctcgtcggcgtaagtgtgttttctcaacatgtcgacgatctcggcctttgagtgagcttcaagaaaagctaaatcgccgtcttccagaacgttcttgaagttgacgacggcgtcgcggccacggaatctacaagctgcgatgtcgtaggaacgagcagcttcttcttgctcgttgaaagtcccgagccatactcgttggtgcttctcgtagatctgagctccccatcttccgttaggctgaggaacaacacctttgtattttgaagatggtagctttcgtgactccgtctctaggccgttctcgggatccaacacgacgctgctcccgccgcttcccatccggtagaggcgtaacgccgccgcgggaggaggagagagcttcttggcggtggtggcggagaaagattctgaagtggaggaacttatctcgtctatgcaactagaatccat

SEQ ID NO: 130 - DNA, 1498 bp, Arabidopsis thaliana
  G14 cDNA Sequence
gaagaagcaaagatataacccccaaaagtatcaattagtttccattttcgccgctaagattctgttttcgaacatttacaccctcaagaatcgccgccatgtgtggaggagctataatatccgatttcattccaccgccgaggtctcgccgtgttactagcgagtttatttggccggatctgaagaagaatttgaaaggatcgaagaaaagctcgaagaatcgttcgaatttcttcgattttgacgctgagttcgaagctgatttccaaggtttcaaagatgattcgtctatcgattgcgatgatgatttcgacgtcggtgatgttttcgccgatgtgaaaccattcgttttcacttcgactccaaaacccgccgtctccgccgctgcggaaggttcagtttttggtaagaaagttactggcttggatggggacgctgagaaatctgcaaataggaagaggaagaatcagtaccgagggattaggcaacgtccttggggaaaatgggctgctgagatacgtgatccaagggaaggtgctagaatctggcttggaacgttcaagacagctgaggaagctgctagagcttacgatgctgcagcgcggagaatccgtggatctaaagctaaggtgaatttccctgaagaaaacatgaaggctaattctcagaaacgctctgtgaaggctaatcttcagaaaccagtggctaaacctaaccctaacccaagtccagctttggttcagaactcgaacatctcctttgaaaatatgtgtttcatggaggagaaacaccaagtgagcaacaacaacaacaaccagtttgggatgacaaactccgttgatgctggatgtaatgggtatcagtatttcagctctgaccagggtagtaattctttcgattgttcggagtttggttggagcgatcaagctccgataactcccgacatctcttctgcggttatcaacaacaacaactcagctctgttctttgaggaagccaatccagctaagaagctcaagtctatggatttcgagacaccttacaacaacactgaatgggacgcttcactggatttcctcaacgaagatgctgtaacgactcaggacaatggtgcaaaccctatggacctatggagtattgatgaaattcattccatgattggaggagtcttctgaagagatccagtttcatgtaaataaggctgcatgtttgtgagtttcccgcatcgttcgtttatcaacctccaaaactttctaatgtctgttacttgcatcttcttctgctgtctctgtctgtctctctcaggagttcctgtttgcattgcgagaagccatgagcctctatcttgagggtagttgtgatgaagttaagtagaggcttatttttaggggttgtggtagtttttgttttagtgaatcttttgaattcgtttgtgttttgtttttgttactttatgccccaaaactcctttaacatttgtcataatgtgtttgaacct

SEQ ID NO: 131 - protein, 358 aa, Arabidopsis thaliana
  G14 Amino Acid Sequence
MCGGAIISDFIPPPRSRRVTSEFIWPDLKKNLKGSKKSSKNRSNFFDFDAEFEADFQGFKDDSSIDCDDDFDVGDVFADVKPFVFTSTPKPAVSAAAEGSVFGKKVTGLDGDAEKSANRKRKNQYRGIRQRPWGKWAAEIRDPREGARIWLGTFKTAEEAARAYDAAARRIRGSKAKVNFPEENMKANSQKRSVKANLQKPVAKPNPNPSPALVQNSNISFENMCFMEEKHQVSNNNNNQFGMTNSVDAGCNGYQYFSSDQGSNSFDCSEFGWSDQAPITPDISSAVINNNNSALFFEEANPAKKLKSMDFETPYNNTEWDASLDFLNEDAVTTQDNGANPMDLWSIDEIHSMIGGVF

SEQ ID NO: 132 - DNA, 1340 bp, Arabidopsis thaliana
  G14 Genomic Sequence
atgtgtggaggagctataatatccgatttcattccaccgccgaggtctcgccgtgttactagcgagtttatttggccggatctgaagaagaatttgaaaggatcgaagaaaagctcgaagaatcgttcgaatttcttcgattttgacgctgagttcgaagctgatttccaaggtttcaaagatgattcgtctatcgattgcgatgatgatttcgacgtcggtgatgttttcgccgatgtgaaaccattcgttttcacttcgactccaaaacccgccgtctccgccgctgcggaaggtaaatatttagggattgactttagtttgagcgattgaattggttagaaattaagtttcgattctatttagctctgttcatagatacctttatctgcttacgattttgattgttgtataaagcatgaggtttgatttgtgtgatatttatatgcatatgaggttgagtgatgagacttgatttgtgtgatgagatttgattagagattgttgatgagttatttatagaagaactcttttgttttgttgttgtttcactactaggttcagtttttggtaagaaagttactggcttggatggggacgctgagaaatctgcaaataggaagaggaagaatcagtaccgagggattaggcaacgtccttggggaaaatgggctgctgagatacgtgatccaagggaaggtgctagaatctggcttggaacgttcaagacagctgaggaagctgctagagcttacgatgctgcagcgcggagaatccgtggatctaaagctaaggtgaatttccctgaagaaaacatgaaggctaattctcagaaacgctctgtgaaggctaatcttcagaaaccagtggctaaacctaaccctaacccaagtccagctttggttcagaactcgaacatctcctttgaaaatatgtgtttcatggaggagaaacaccaagtgagcaacaacaacaacaaccagtttgggatgacaaactccgttgatgctggatgtaatgggtatcagtatttcagctctgaccagggtagtaattctttcgattgttcggagtttggttggagcgatcaagctccgataactcccgacatctcttctgcggttatcaacaacaacaactcagctctgttctttgaggaagccaatccagctaagaagctcaagtctatggatttcgagacaccttacaacaacactgaatgggacgcttcactggatttcctcaacgaagatgctgtaacgactcaggacaatggtgcaaaccctatggacctatggagtattgatgaaattcattccatgattggaggagtcttctga

SEQ ID NO: 133 - DNA, 1340 bp, Arabidopsis thaliana; identical to SEQ ID NO: 132
  G14 DNA sequence used for BLAST

SEQ ID NO: 134 - DNA, 1055 bp, Arabidopsis thaliana; identical to SEQ ID NO: 3
  G19 cDNA Sequence

SEQ ID NO: 135 - protein, 248 aa, Arabidopsis thaliana
  G19 Amino Acid Sequence
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 136 - DNA, 985 bp, Arabidopsis thaliana
  G19 Genomic Sequence
atgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaaggtatgtactctcctattaatcataaacaaaaatacaaaatcattcaaaaacacaaacatatagttttttctaacctttttagcaaaaaggtaaaataatatttctggaacttacggaagatgataaaaaaaaaatatttgtggttttggtaatgtaatttatcaggattatttaattatctgtgtggggttaaaattgtaaattttgaactttggggaatccggtgaaaattttgaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaa

SEQ ID NO: 137 - DNA, 985 bp, Arabidopsis thaliana; identical to SEQ ID NO: 136
  G19 DNA sequence used for BLAST

SEQ ID NO: 138 - DNA, 1650 bp, Arabidopsis thaliana
  G20 cDNA Sequence
ctctcactctctttttctctctctttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctcttaaaaaaaaaaaaaaaa

SEQ ID NO: 139 - protein, 428 aa, Arabidopsis thaliana
  G20 Amino Acid Sequence
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRYPFGRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 140 - DNA, 2630 bp, Arabidopsis thaliana
  G20 Genomic Sequence
atggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccaggtactgtgacttttcaaatcgggattgtcggtttatgatgcggaggagattggagtataggtttggttgtgaattgggagttgtgttatctgtattagagtatggaatgtttggattggtggatatgcactttggttagggatcttgtgtggagctaaattatctggaatctgtaaactgttctaaaacacactaattttcacctaatgtcagattttatagtgtctaggctcaaactagaagaaatgagtaggtgtgcttagcatctgtatgaggtttttgttccatagcagttggagatgttgatgcgttttgtttgtcgtatttgtgttgagtacagacatagatggacaggtcgttatgaagctcacctttgggataagagtacctggaaccaaaaccagaacaagaagggaaaacaaggttcctcttcttcttttttttttctctctgcatctgataaaattgctgttgtcatttgcaataagttttctcttgtttggagtatcaaagctgatcttttctgtttcctatatattttcatgggtgacggaatttcgccacaccagtttatctaggtaagctaaaagctttatatgtgttgattatattcttgtatatcaaattggataatttttcactgaagaacccaactcttacttgacaggagcatatgatgatgaagaggctgctgctagagcttacgaccttgctgccttaaaatattggggtcctgggacacttataaattttccggtgagattgctaccgtagtatgctttctaagttactcttcaaccgtgtggtttccttaataattttcatggtcaatatatatgcataagtggagtaaggatggttagaagtgttttggagccacccttctcaagtttcactgtttttagctacatgcatttacgtatttcattctcgtaggtgactgattataccagggatttagaagaaatgcaaaatctctcaagggaagaataccttgcatctttacgtaggtgcgtatgtatttaaaagcactatagttttcttttaagaaccatttattgctgatactctttagatatccctttggcagaaaaagcagcggtttctctaggggaatagcgaaatatcgtggacttcaaaggtaaaactggaccagcaattgagttctcatttctctgttttgtctgaaaaactatggaatcaagagtgatcatctttgtgtaattgcctataaggaagattctttagtgacacattgtggatcatcacggttttgattaattgacatatggtggatatgctactagttaatttcatagaaaagtctatatgctactcttaagaatagggatatggcaaaactatcttcactgttttggctgtagccctctttagttttgtctttttaaccttctttctcacaattaacattcatacctgatatgcatttctgctgtctttccatctattctgcacttcccgaccagccgatgggacgcatcagccagtcgtatgcctggacctgaatacttcagtaacattcattacggtgagttgctaacaatattgacctaattgaaacaaatgtttgcttgcatcagactattcaaaactcattgtcattattaacaggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggttcgtagtcatatatctatagaaccagagacttcagaggttactacaacacatcttccttatgtcattttctttggctctctttcttctgcaggtgacaaagacagagaccagctgttccacgtacagctacctcccacaagagaaatga

SEQ ID NO: 141 - DNA, 2630 bp, Arabidopsis thaliana; identical to SEQ ID NO: 140
  G20 DNA sequence used for BLAST

SEQ ID NO: 142 - DNA, 913 bp, Arabidopsis thaliana; identical to SEQ ID NO: 19
  G22 cDNA Sequence

SEQ ID NO: 143 - protein, 226 aa, Arabidopsis thaliana
  G22 Amino Acid Sequence
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 144 - DNA, 681 bp, Arabidopsis thaliana
  G22 Genomic Sequence
atgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataa

SEQ ID NO: 145 - DNA, 681 bp, Arabidopsis thaliana
  G22 DNA sequence used for BLAST
ttatatccgattatcagaataagaacattctgattggtccattaataaactaccatcgaagtaaaactgatccaccgtgaaatccaactccggtacaaccaaactagactcgccgtcatccacgtggctttccctcttctgctccgacgttaactgatcggagactgacggttccggcgagcgacggcgaggcctaatcctaaccggctcatacttacaagaaccaatcaaatgcggaaaattcagcttagctttcgatcctctgagctgaaacgccgctcggtcgtacgccaccgccgcgtcctccggcgtctcgtaagtcccgagccaaaccctagctccgttcttcttcggatccctaatctccgccgcgaatttcccccacggcctcctcctcactcctctgtactgcatccccttctgcctcggcgcgtgtgagccactcgccttcgtcgccggaggcttattttcctccgccggagaggtaacgggaggaacggagggtgtccagccggagctaacggcatcacggagagtgttgtaaatagccatgtcttgagaatcgtcgacacttaacggcaagtcgctccagttatcgtttaagataacgttgctgaaactcgggttacggaagtacatccgtgagttaacgccgttattaacggaatcagatgagctcat

SEQ ID NO: 146 - DNA, 970 bp, Arabidopsis thaliana
  G23 cDNA Sequence
tatcaaacgagagtacaaaagatgacgtcactcaacagctctgcatcaccaacatcatcgtcatcagaccaatctgatgcaactactacaacaagcacccacttgtctgaagaagaagctccacccagaaacaacaacacaagaaagagaaggagagattcttcttctgcttcttcatcttcttcaatgcaacatcctgtttacagaggtgtgcggatgagaagttggggcaaatgggtctccgagatccgacaacctcgtaagaaaactcgtatttggctcggcacttttgtcaccgctgatatggctgctcgtgctcacgacgtcgctgctctcaccatcaaaggctcctccgccgtcttaaatttccctgagcttgcttctctcttccctcgtccggcgtcatcatcgccgcatgatatccagacagccgccgcagaagccgccgccatggtggtcgaagaaaaactgttagagaaggatgaggctccggaggccccaccttcgtcggaatcttcttacgtggcggcggagtcagaggatgaggagaggttggagaaaattgtggagctgcctaacattgaagaaggaagttatgacgagagtgtgacatcacgtgctgatctggcttattctgagccgttcgattgttgggtgtatcctccggttatggatttttatgaagaaatatcggagtttaatttcgtggaattgtggagctttaatcactaattaagttaggaaagtgcattatattgcaatattgcatcatagataacatttgtatttcttttctttttgtacggatacgtagcatatgctactatactagggctagtgtaccaaatattgtaaaatatacttattaatatttatgtaaatgtgtaatatatataacatacaattattgtaagtttggaaattggaaactatcgttacgcaatgttcttgtaaaaaaaaaaaaaaaaaa

SEQ ID NO: 147 - protein, 236 aa, Arabidopsis thaliana
  G23 Amino Acid Sequence
MTSLNSSASPTSSSSDQSDATTTTSTHLSEEEAPPRNNNTRKRRRDSSSASSSSSMQHPVYRGVRMRSWGKWVSEIRQPRKKTRIWLGTFVTADMAARAHDVAALTIKGSSAVLNFPELASLFPRPASSSPHDIQTAAAEAAAMVVEEKLLEKDEAPEAPPSSESSYVAAESEDEERLEKIVELPNIEEGSYDESVTSRADLAYSEPFDCWVYPPVMDFYEEISEFNFVELWSFNH

SEQ ID NO: 148 - DNA, 711 bp, Arabidopsis thaliana
  G23 Genomic Sequence
atgacgtcactcaacagctctgcatcaccaacatcatcgtcatcagaccaatctgatgcaactactacaacaagcacccacttgtctgaagaagaagctccacccagaaacaacaacacaagaaagagaaggagagattcttcttctgcttcttcatcttcttcaatgcaacatcctgtttacagaggtgtgcggatgagaagttggggcaaatgggtctccgagatccgacaacctcgtaagaaaactcgtatttggctcggcacttttgtcaccgctgatatggctgctcgtgctcacgacgtcgctgctctcaccatcaaaggctcctccgccgtcttaaatttccctgagcttgcttctctcttccctcgtccggcgtcatcatcgccgcatgatatccagacagccgccgcagaagccgccgccatggtggtcgaagaaaaactgttagagaaggatgaggctccggaggccccaccttcgtcggaatcttcttacgtggcggcggagtcagaggatgaggagaggttggagaaaattgtggagctgcctaacattgaagaaggaagttatgacgagagtgtgacatcacgtgctgatctggcttattctgagccgttcgattgttgggtgtatcctccggttatggatttttatgaagaaatatcggagtttaatttcgtggaattgtggagctttaatcactaa

SEQ ID NO: 149 - DNA, 711 bp, Arabidopsis thaliana
  G23 DNA sequence used for BLAST
ttagtgattaaagctccacaattccacgaaattaaactccgatatttcttcataaaaatccataaccggaggatacacccaacaatcgaacggctcagaataagccagatcagcacgtgatgtcacactctcgtcataacttccttcttcaatgttaggcagctccacaattttctccaacctctcctcatcctctgactccgccgccacgtaagaagattccgacgaaggtggggcctccggagcctcatccttctctaacagtttttcttcgaccaccatggcggcggcttctgcggcggctgtctggatatcatgcggcgatgatgacgccggacgagggaagagagaagcaagctcagggaaatttaagacggcggaggagcctttgatggtgagagcagcgacgtcgtgagcacgagcagccatatcagcggtgacaaaagtgccgagccaaatacgagttttcttacgaggttgtcggatctcggagacccatttgccccaacttctcatccgcacacctctgtaaacaggatgttgcattgaagaagatgaagaagcagaagaagaatctctccttctctttcttgtgttgttgtttctgggtggagcttcttcttcagacaagtgggtgcttgttgtagtagttgcatcagattggtctgatgacgatgatgttggtgatgcagagctgttgagtgacgtcat

SEQ ID NO: 150 - DNA, 751 bp, Arabidopsis thaliana
  G25 cDNA Sequence
aggactcggttcaaaaacgaaaacgcaaatacgtcttgttctagtttggagttggaagcgtaaaaaacaaaaaacaaaaatgtgtgggggagctatcatttctgatttcatctggtcgaaatctgagtcagaaccgagtcaactcggctctgttagcagcaggaagaagcgtaaacccgtctcagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaattaaatctcttatttcccggccggtttgctcactcattaatatgctgctaatttacttgttttttacttaacaatcaagtctaatttgtttccatcaatatttcagataagagtaaagcttcaattgtctttaaaaaaaaaaaaaaaaaaaaaaaaaaaa

SEQ ID NO: 151 - protein, 171 aa, Arabidopsis thaliana
  G25 Amino Acid Sequence
MCGGAIISDFIWSKSESEPSQLGSVSSRKKRKPVSVSEERDGKRERKNLYRGIRQRPWGKWAAEIRDPSKGVRVWLGTFKTADEAARAYDVAAIKIRGRKAKLNFPNTQVEEEADTKPGGNQNELISENQVESLSEDLMALEDYMRFYQIPVADDQSATDIGNLWSYQDSN

SEQ ID NO: 152 - DNA, 600 bp, Arabidopsis thaliana
  G25 Genomic Sequence
atgtgtgggggagctatcatttctgatttcatctggtcgaaatctgagtcagaaccgagtcaactcggctctgttagcagcaggaagaagcgtaaacccgtctcaggtacaacacttttggtttcgagttttgtttttttattataaaacctaatatatccgtttctgattcgggaatatcttcgaacagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaattaa

SEQ ID NO: 153 - DNA, 600 bp, Arabidopsis thaliana; identical to SEQ ID NO: 152
  G25 DNA sequence used for BLAST

SEQ ID NO: 154 - DNA, 1084 bp, Arabidopsis thaliana; identical to SEQ ID NO: 60
  G26 cDNA Sequence

SEQ ID NO: 155 - protein, 218 aa, Arabidopsis thaliana
  G26 Amino Acid Sequence
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 156 - DNA, 1382 bp, Arabidopsis thaliana
  G26 Genomic Sequence
atgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaaggtaatttcatcagatcctttttccaataattttaattgctatactttataactcgagtgattgtcttttccattggtgattctctttacacataggaatgatttaatcttggattttgcaattggtaatcctttagtggctgcagcatggccttgatcaaatagagatataatttcatgtatggccacaatgcattagttcaatttactatatgatttttttaatgaatgttcatggttagattttcttgaaaaaacctgtcggctttattggttggacaaaattgatcatatttggctttcggacaaatatgattggcaaggcttggttgcaatggtcgtattttggttgagataactagccagagagagttttaggattgtaacatggggaaaacgtatttaaaatgatcaaacttaatttatatcctaattatatcattggtgtgatacataagtatatatatagttaattaccaattacgagagagaggaatgtataaatgtaggtttggcctaatatatagatttcataagtagatgtagaagaggggaataaaagttgatgtagaatgatcatatcatatgattcaaacgccctttaataatctttacgaaatgcctctacaccgatagtatacgttatattcatagacatgcacgtcacatttaagtcaccattttcatgacaagagtgaacttacaattttcatcatttttctacagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataa

SEQ ID NO: 157 - DNA, 1382 bp, Arabidopsis thaliana
  G26 DNA sequence used for BLAST
ttattttcgtcgtttgtggatactaatgttcttcacgttttcaccatcctccaaatttggtcttagcccttgatgattcaaagatgaagacgaagaagacagcatattcatggacaagttggcactggaatcactacttcgagattgaaagtggccatattgatcaagaagtatgtcaggagcaattggtggaggtggactaggtggtgtcacgataatgcgatcatgggaagtagcgggcgatggatagagttgagtagggttgacacgaatatgctcggggaagttaagcttggccttgtgacctctaaactcaaatgcagctttatcatacgctaaggcggcttcttctgcagtgtcgaacgtcccaagccacacacgagctgccttgttcgggtcacgaatctcagccgcccattttccccacggtctttgcctcacgcctctgtagtttcgttgcctcgagttacttttttctgtagaaaaatgatgaaaattgtaagttcactcttgtcatgaaaatggtgacttaaatgtgacgtgcatgtctatgaatataacgtatactatcggtgtagaggcatttcgtaaagattattaaagggcgtttgaatcatatgatatgatcattctacatcaacttttattcccctcttctacatctacttatgaaatctatatattaggccaaacctacatttatacattcctctctctcgtaattggtaattaactatatatatacttatgtatcacaccaatgatataattaggatataaattaagtttgatcattttaaatacgttttccccatgttacaatcctaaaactctctctggctagttatctcaaccaaaatacgaccattgcaaccaagccttgccaatcatatttgtccgaaagccaaatatgatcaattttgtccaaccaataaagccgacaggttttttcaagaaaatctaaccatgaacattcattaaaaaaatcatatagtaaattgaactaatgcattgtggccatacatgaaattatatctctatttgatcaaggccatgctgcagccactaaaggattaccaattgcaaaatccaagattaaatcattcctatgtgtaaagagaatcaccaatggaaaagacaatcactcgagttataaagtatagcaattaaaattattggaaaaaggatctgatgaaattaccttgaagagtaagcgacgaagattgatcatcaatggatgatgggatgggttgaccagtgagttcagagacaaaatcagacacatcagattccgacaaagttgagcaacaacacaactcttttttctcttctctatttccggccattgattctggtgatagaggtctcttcccgctatgcat

SEQ ID NO: 158 - DNA, 881 bp, Arabidopsis thaliana; identical to SEQ ID NO: 105
  G27 cDNA Sequence

SEQ ID NO: 159 - protein, 179 aa, Arabidopsis thaliana
  G27 Amino Acid Sequence
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 160 - DNA, 540 bp, Arabidopsis thaliana
  G27 Genomic Sequence
atgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactag

SEQ ID NO: 161 - DNA, 540 bp, Arabidopsis thaliana
  G27 DNA sequence used for BLAST
ctagtaattttccaagaagaaaggatcttcgtacggaaacgagtcccagaatccatcgtttttgttgtgatcattcacgtcaagcaaaagatcaggaagatcggagaaagcgtcgtcggcgactggagatgacgtcacggtgctagacggagactccggtgctttccagtcaacggcagctgctgcggcggcggcttcttgaatgtctttagggtccgcgctagccggtctcggcaaatggtaagctagctccgggaaattaaggtgggcagagccacctttgatggctaaagccgccacgtcgtgtgcacgcgccgccatctccggcgtagagaaagtaccgagccatattcttgatttctttcttggttctctaatttcagacacccattttccccattgtctcattctgaccccacgaaaatttggttgtttagaaacacctttttgctcatttttagtcttagaactctttccggttttctccggcaccggtgaccggaggttacgttgcgattcgtgagaggaagagtcttgcat

SEQ ID NO: 162 - DNA, 964 bp, Arabidopsis thaliana; identical to SEQ ID NO: 5
  G28 cDNA Sequence

SEQ ID NO: 163 - protein, 268 aa, Arabidopsis thaliana
  G28 Amino Acid Sequence
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 164 - DNA, 808 bp, Arabidopsis thaliana
  G28 Genomic Sequence
atgtcgatgacggcggattctcaatctgattatgcttttcttgagtccatacgacgacacttactaggaggaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagacccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataa

SEQ ID NO: 165 - DNA, 808 bp, Arabidopsis thaliana; identical to SEQ ID NO: 164
  G28 DNA sequence used for BLAST

SEQ ID NO: 166 - DNA, 1025 bp, Arabidopsis thaliana
  G29 cDNA Sequence
cctcttcaattctctgtttcctccaaaatggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccaccgtttggttatccacaattgaccgttgtttgaattctatttttctgtttgggtcagcttgttgtatgctgacgtggaattatgctatatcttttgcttattttatgttcacattcgagcaaaatttattcattcgtttatttgttttttaatacaactcttgatatttctaaattctaacc

SEQ ID NO: 167 - protein, 282 aa, Arabidopsis thaliana
  G29 Amino Acid Sequence
MATPNEVSALFLIKKYLLDELSPLPTTATTNRWMNDFTSFDQTGFEFSEFETKPEIIDLVTPKPEIFDFDVKSEIPSESNDSFTFQSNPPRVTVQSNRKPPLKIAPPNRTKWIQFATGNPKPELPVPVVAAEEKRHYRGVRMRPWGKFAAEIRDPTRRGTRVWLGTFETAIEAARAYDKEAFRLRGSKAILNFPLEVDKWNPRAEDGRGLYNKRKRDGEEEEVTVVEKVLKTEESYDVSGGENVESGLTAIDDWDLTEFLSMPLLSPLSPHPPFGYPQLTVV

SEQ ID NO: 168 - DNA, 846 bp, Arabidopsis thaliana
  G29 Genomic Sequence
atggctacaccaaacgaagtatcagctcttttcctcatcaagaagtatctcctcgacgaattgtctccgttgcctactactgccaccaccaatcgatggatgaacgatttcacgtcatttgatcaaaccggtttcgagttttctgaatttgaaaccaaaccggaaataatcgatctcgtcactcccaaaccggagatttttgatttcgatgtgaaatctgaaattccatctgaatcgaacgattccttcacgttccaatcgaatcctcctcgcgttactgttcaatccaatcgaaaaccgccgttgaagatcgcaccaccgaaccgaaccaagtggattcaattcgcaaccggaaatcctaaaccggaacttcccgtaccggttgtagcagcagaggagaagaggcattacagaggagtgaggatgaggccgtgggggaaattcgcggcggagattcgagacccgactcgtcgtggaactcgtgtttggctcgggacgtttgagacggcgatcgaagcggctagagcttacgacaaagaagcgtttagactacgaggatcaaaggcgattctgaatttcccgcttgaagttgacaagtggaatccacgcgctgaagatggtcgtggcctgtacaacaaacggaagagagacggcgaggaggaggaagtgacggtggttgagaaagtgctaaagacggaggagagttacgacgttagcggcggcgagaatgttgagtcaggtttgacggcgatagatgactgggatttgacggagtttctgagcatgccgcttttatcgccgttatctccacacccaccgtttggttatccacaattgaccgtttga

SEQ ID NO: 169 - DNA, 846 bp, Arabidopsis thaliana
  G29 DNA sequence used for BLAST
aacaacggtcaattgtggataaccaaacggtgggtgtggagataacggcgataaaagcggcatgctcagaaactccgtcaaatcccagtcatctatcgccgtcaaacctgactcaacattctcgccgccgctaacgtcgtaactctcctccgtctttagcactttctcaaccaccgtcacttcctcctcctcgccgtctctcttccgtttgttgtacaggccacgaccatcttcagcgcgtggattccacttgtcaacttcaagcgggaaattcagaatcgcctttgatcctcgtagtctaaacgcttctttgtcgtaagctctagccgcttcgatcgccgtctcaaacgtcccgagccaaacacgagttccacgacgagtcgggtctcgaatctccgccgcgaatttcccccacggcctcatcctcactcctctgtaatgcctcttctcctctgctgctacaaccggtacgggaagttccggtttaggatttccggttgcgaattgaatccacttggttcggttcggtggtgcgatcttcaacggcggttttcgattggattgaacagtaacgcgaggaggattcgattggaacgtgaaggaatcgttcgattcagatggaatttcagatttcacatcgaaatcaaaaatctccggtttgggagtgacgagatcgattatttccggtttggtttcaaattcagaaaactcgaaaccggtttgatcaaatgacgtgaaatcgttcatccatcgattggtggtggcagtagtaggcaacggagacaattcgtcgaggagatacttcttgatgaggaaaagagctgatacttcgtttggtgtagccat

SEQ ID NO: 170 - DNA, 553 bp, Arabidopsis thaliana
  G30 cDNA Sequence
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 171 - protein, 133 aa, Arabidopsis thaliana
  G30 Amino Acid Sequence
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 172 - DNA, 402 bp, Arabidopsis thaliana
  G30 Genomic Sequence
atggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataa

SEQ ID NO: 173 - DNA, 402 bp, Arabidopsis thaliana
  G30 DNA sequence used for BLAST
ttattgcctcttgcccatgttgatattatgagtcttgttatagttctctccatattcaagaagttcatccaaaacgctatcgtccaagtactcaaactcaaaaacttgctgcgacgaggaagaagaattagccgcagtggatgaggatccggttcccatgttatactcgtgagggaagttgagaatggcagctttgcctctcattgaataggcggctcggtcataggctcgagccgcgtcttccgcagtgtcgaatgtccctagccacacacgctctccgtgcttcctcgaatctcttatttccgcggcgtatttaccccaaggtcgtctccttactccacggtacttcccttgctcggctcctcctcctccactaccactgctacgacctccttgatccat

SEQ ID NO: 174 - DNA, 800 bp, Arabidopsis thaliana
  G35 cDNA Sequence
ggattctaaaagataagagaaacagtaagtcggttaattttggattaagtaacgcacaagccaaagccttctcctgatcgaatcataaaccaaacaaatctttcttttaaaagaagcggacacaaaccctaaccaccaaccctctccgtcgtcaaatttcccggcgaaagatgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttgattttcttgtttataactaactttgcaaggttacttttgtttatcatcatcttttgtaaatttgatcatcttgctctttgctttttaacttctcttgtacatgtttgaattataaaagttctaatttttcaatcaaaaaaaaaaaaaaaaa

SEQ ID NO: 175 - protein, 159 aa, Arabidopsis thaliana
  G35 Amino Acid Sequence
MKRIVRISFTDMEATDSSSSEDESPPSSRRRGKKLVKEIVIDHSDPPEVGKTRFKIRIPASLLAARNTTANKKKFRGVRQRPWGKWAAEIRCGRVKGRPERIWLGTFETAEEAALAYDNAAIQLIGPDAPTNFGRPDVDSAVVKKQDSDASGGASEEVV

SEQ ID NO: 176 - DNA, 480 bp, Arabidopsis thaliana
  G35 Genomic Sequence
atgaaacgaattgttcgaatttcattcacagacatggaagcaaccgattcttcaagcagcgaagacgagtcaccaccgtcatcacgccgtcgaggtaagaagctagtcaaggaaatcgtaatcgatcattctgatcccccggaggtcggaaaaactcggttcaaaatcaggattccggcgagtttacttgctgcgaggaatacgacggcgaataagaagaagttccgtggcgtgaggcagagaccatgggggaagtgggcggctgagattagatgtggtagagttaaaggaagacctgaacgaatttggcttggaacttttgaaacagctgaagaagctgctcttgcttatgataacgctgcgattcagttgattggacctgatgcgccgactaattttggccgtcctgatgttgattctgcggtggtgaaaaagcaagattctgatgctagtggtggtgcttctgaagaagttgtttga

SEQ ID NO: 177 - DNA, 480 bp, Arabidopsis thaliana; identical to SEQ ID NO: 176
  G35 DNA sequence used for BLAST

SEQ ID NO: 178 - DNA, 1251 bp, Arabidopsis thaliana
  misc_feature (973)..(973): n is a, c, g, or t
  G36 cDNA Sequence
cccacgcgtccgaaaaaatgctataattcttcctttttcttgttctttcagagattttgatttctattcaatcgactaagagggtgtgtttttaatccctctctgttttaattttgtttcctagtctttaaagatccatggcagccatagatatgttcaatagcaacacagatccttttcaagaagagctcatgaaagcacttcaaccttataccaccaacactgattcttcttctcctacgtattcaaacacagtcttcggtttcaatcaaaccacatctctcggtctaaaccagctcacaccttaccaaatccaccaaatccaaaaccagcttaaccagagacgtaacataatctctccaaatctagccccaaagcctgtcccaatgaagaacatgaccgctcagaaactctatagaggagttagacaaaggcactggggaaaatgggtagctgagatccgtttacccaagaaccggacccgactctggcttggaactttcgacacagctgaagaagcagccatggcttatgacctagctgcttacaagctaagaggcgagttcgcgagacttaatttcccacagttcagacacgaggatggatactacggaggaggtagctgtttcaatcctcttcattcctctgtcgacgcaaagctccaagagatttgtcagagcttgagaaaaacagaggatattgacctcccctgttctgaaacagagcttttcccgccaaaaacagagtatcaagaaagtgaatatgggttcttgagatctgatgagaattcgttttcagatgagtctcatgtggaatcttcttcgccggaatctggtattactacgttcttggacttttcggattctggatttgatgagattgggagtttcgggctggagaagtttccttctgtggagattgattgggatgcgattagcaaattgtccgaatcttaaacaaagcaaagagaagnctttttcttttaggagtttgtctttcaatttcagtgtcttatattaatctctctgcaactgaaatttttaacagttgcggagagaatcgtctctagggtttgtttctcttcctccatgttttggtctgactggtttatgtcttttttttttttttgaactttcaaaaacctttgtcattgaccaatcggagaagtttccatgtattctctcatctttaaatttctaatgaagaatgtaaattattagtcttttgctaaaaaaaaaaaaaaaaaaaaaa

SEQ ID NO: 179 - protein, 272 aa, Arabidopsis thaliana
  G36 Amino Acid Sequence
MAAIDMFNSNTDPFQEELMKALQPYTTNTDSSSPTYSNTVFGFNQTTSLGLNQLTPYQIHQIQNQLNQRRNIISPNLAPKPVPMKNMTAQKLYRGVRQRHWGKWVAEIRLPKNRTRLWLGTFDTAEEAAMAYDLAAYKLRGEFARLNFPQFRHEDGYYGGGSCFNPLHSSVDAKLQEICQSLRKTEDIDLPCSETELFPPKTEYQESEYGFLRSDENSFSDESHVESSSPESGITTFLDFSDSGFDEIGSFGLEKFPSVEIDWDAISKLSES

SEQ ID NO: 180 - DNA, 819 bp, Arabidopsis thaliana
  G36 Genomic Sequence
atggcagccatagatatgttcaatagcaacacagatccttttcaagaagagctcatgaaagcacttcaaccttataccaccaacactgattcttcttctcctacgtattcaaacacagtcttcggtttcaatcaaaccacatctctcggtctaaaccagctcacaccttaccaaatccaccaaatccaaaaccagcttaaccagagacgtaacataatctctccaaatctagccccaaagcctgtcccaatgaagaacatgaccgctcagaaactctatagaggagttagacaaaggcactggggaaaatgggtagctgagatccgtttacccaagaaccggacccgactctggcttggaactttcgacacagctgaagaagcagccatggcttatgacctagctgcttacaagctaagaggcgagttcgcgagacttaatttcccacagttcagacacgaggatggatactacggaggaggtagctgtttcaatcctcttcattcctctgtcgacgcaaagctccaagagatttgtcagagcttgagaaaaacagaggatattgacctcccctgttctgaaacagagcttttcccgccaaaaacagagtatcaagaaagtgaatatgggttcttgagatctgatgagaattcgttttcagatgagtctcatgtggaatcttcttcgccggaatctggtattactacgttcttggacttttcggattctggatttgatgagattgggagtttcgggctggagaagtttccttctgtggagattgattgggatgcgattagcaaattgtccgaatcttaa

SEQ ID NO: 181 - DNA, 819 bp, Arabidopsis thaliana
  G36 DNA sequence used for BLAST
ttaagattcggacaatttgctaatcgcatcccaatcaatctccacagaaggaaacttctccagcccgaaactcccaatctcatcaaatccagaatccgaaaagtccaagaacgtagtaataccagattccggcgaagaagattccacatgagactcatctgaaaacgaattctcatcagatctcaagaacccatattcactttcttgatactctgtttttggcgggaaaagctctgtttcagaacaggggaggtcaatatcctctgtttttctcaagctctgacaaatctcttggagctttgcgtcgacagaggaatgaagaggattgaaacagctacctcctccgtagtatccatcctcgtgtctgaactgtgggaaattaagtctcgcgaactcgcctcttagcttgtaagcagctaggtcataagccatggctgcttcttcagctgtgtcgaaagttccaagccagagtcgggtccggttcttgggtaaacggatctcagctacccattttccccagtgcctttgtctaactcctctatagagtttctgagcggtcatgttcttcattgggacaggctttggggctagatttggagagattatgttacgtctctggttaagctggttttggatttggtggatttggtaaggtgtgagctggtttagaccgagagatgtggtttgattgaaaccgaagactgtgtttgaatacgtaggagaagaagaatcagtgttggtggtataaggttgaagtgctttcatgagctcttcttgaaaaggatctgtgttgctattgaacatatctatggctgccat

SEQ ID NO: 182 - DNA, 1440 bp, Arabidopsis thaliana; identical to SEQ ID NO: 61
  G38 cDNA Sequence

SEQ ID NO: 183 - protein, 335 aa, Arabidopsis thaliana
  G38 Amino Acid Sequence
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 184 - DNA, 1008 bp, Arabidopsis thaliana
  G38 Genomic Sequence
atggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaa

SEQ ID NO: 185 - DNA, 1008 bp, Arabidopsis thaliana; identical to SEQ ID NO: 184
  G38 DNA sequence used for BLAST

SEQ ID NO: 186 - DNA, 754 bp, Arabidopsis thaliana
  misc_feature (677)..(677): n is a, c, g, or t
  G39 cDNA Sequence
gtttccacagtccctgtacttgtgcataaaactgtaaaacactactctgaaaattttgcttctgttaggatataatgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatctgatgtgtaacgtcacttgcagtgacatttaatatggtttanctatcagttacctgtctgcttcttgtaagggtatacttggatccttgtctttgaacttgttttatttagcatgcaaa

SEQ ID NO: 187 - protein, 187 aa, Arabidopsis thaliana
  G39 Amino Acid Sequence
MPPSPPKSPFISSSLKGAHEDRKFKCYRGVRKRSWGKWVSEIRVPKTGRRIWLGSYDAPEKAARAYDAALFCIRGEKGVYNFPTDKKPQLPEGSVRPLSKLDIQTIATNYASSVVHVPSHATTLPATTQVPSEVPASSDVSASTEITEMVDEYYLPTDATAESIFSVEDLQLDSFLMMDIDWINNLI

SEQ ID NO: 188 - DNA, 564 bp, Arabidopsis thaliana
  G39 Genomic Sequence
atgccaccctctcctcctaaatctccttttattagctcttcactcaaaggagctcatgaagatcgcaaatttaaatgctataggggtgtccgaaagaggtcttggggcaaatgggtgtctgaaatcagagttccaaagactggacgacgaatatggctaggttcatacgatgctccagagaaggcagctagagcctatgatgctgctttgttctgtattaggggtgagaagggagtttacaattttcccactgataaaaagccgcagcttccagaaggttctgtccggcctctgtccaagctcgacatacagacaatagcaacaaactatgcttcatcagttgtgcatgtaccttcccatgccaccacactcccggcaacaacccaggttccctctgaagttcctgcttcctctgatgtttctgcttctactgagattacagagatggtcgatgaatattatctcccaaccgatgcaactgcagaatcaatattctcagttgaagacttacaactggacagtttcctcatgatggacattgattggataaacaatctaatctga

SEQ ID NO: 189 - DNA, 564 bp, Arabidopsis thaliana
  G39 DNA sequence used for BLAST
tcagattagattgtttatccaatcaatgtccatcatgaggaaactgtccagttgtaagtcttcaactgagaatattgattctgcagttgcatcggttgggagataatattcatcgaccatctctgtaatctcagtagaagcagaaacatcagaggaagcaggaacttcagagggaacctgggttgttgccgggagtgtggtggcatgggaaggtacatgcacaactgatgaagcatagtttgttgctattgtctgtatgtcgagcttggacagaggccggacagaaccttctggaagctgcggctttttatcagtgggaaaattgtaaactcccttctcacccctaatacagaacaaagcagcatcataggctctagctgccttctctggagcatcgtatgaacctagccatattcgtcgtccagtctttggaactctgatttcagacacccatttgccccaagacctctttcggacacccctatagcatttaaatttgcgatcttcatgagctcctttgagtgaagagctaataaaaggagatttaggaggagagggtggcat

SEQ ID NO: 190 - DNA, 909 bp, Arabidopsis thaliana; identical to SEQ ID NO: 62
  G43 cDNA Sequence

SEQ ID NO: 191 - protein, 201 aa, Arabidopsis thaliana
  G43 Amino Acid Sequence
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 192 - DNA, 606 bp, Arabidopsis thaliana
  G43 Genomic Sequence
atggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaa

SEQ ID NO: 193 - DNA, 606 bp, Arabidopsis thaliana
  G43 DNA sequence used for BLAST
ttagtttgatgacgatgatgaagtacttgttgttgttccttgaggctgtggtacatcggttctcctcctttttcggcatgaattgaccggagcatcatactttccggcatccaaaggaaagttgagaacagcttttcttcccctgagcttaaaagctgcatagtcgtaagcccttgcagcatcaatatcactctcaaaagtgcctaaccaaatcctggatcctttctttgccggatctcgaatctctgctgcaaatttcccccatggcctccttctcacgcctctgtaatgtctcgtttcttcaaacctctttgtttttttccggtttgagacagtctcaacctcaggtgacgttgttgttgatgatgatgatgatgattctgcttccatttgcagaatctcttggacataggaatctggatcaagaacaggtgaactaggttccagtttcggaactgggttaaagggttctagagaccagagtccggagacaaaagcagtatcatcaaagacaaaatcttcaatgaaaccatcagggatcatcaagtcttcaaatagatgtttctgtataacatccaaatcagagctttcctcaaaagtctccat

SEQ ID NO: 194 - DNA, 997 bp, Arabidopsis thaliana
  G44 cDNA Sequence
cacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgttataaaaaaaaaaaaaaaa

SEQ ID NO: 195 - protein, 241 aa, Arabidopsis thaliana
  G44 Amino Acid Sequence
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 196 - DNA, 726 bp, Arabidopsis thaliana
  G44 Genomic Sequence
atggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaa

SEQ ID NO: 197 - DNA, 723 bp, Arabidopsis thaliana
  G44 DNA sequence used for BLAST
agtgacggagataacggaaaagttgggagacgtcggagataacggaggaatactgaaaataccatctcctgctcccacatcccaaaaccccatccaacttgacggcgtcaatggtaccaccggctcaacctcagcctccgtcgtctccgacgtattactctcttcttcctccactttaaccctagccgccttctcctcttccggcggagaacccttatctcgctttcgtttccctaatccgataactccttccccagaacaagtttctgacgtaaccctaacatcgagagggaaattcaagattgcttttcttccacgtaattgaaacgccgcttggtcataagctcttccagcttccacggcagtgtcgtaagtcccaagccagatcctacaaccctttttgttcggatccctaatctccgccgcgtattttccccacggtcttcgtctcactcccctgtagtgcctctcttcttcctctttctctgtctttgttgaaaccgttctcgagacggatagattcggtaagggcggtttacgctggttaagagtcgaattcggtttaggggattggttggtgatggttctagggcctgtttctgagtgaaagttgtgaagttggttggtaaaaagagatgggtgatcagtttccatggaaacaaagtctgtgagaaggtgttggcttatgaaatcgatggctaaagcttcttgtttagttgccat

SEQ ID NO: 198 - DNA, 1093 bp, Arabidopsis thaliana
  G142 cDNA Sequence
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaacattactacgtgcaaggtgaagggtcttcggtatcaaagagtaacgtggcaggtgagactaatttcgtccaaggttgggttctttgactctctgttgattagcccacgatgccacggtcaggccaatttcagctctctacagttgttcttttttcaaattagatttctggttttttttttcctataagaaaaacttttgcactagatgtttgtcatttaatttccagctcgtgtgaatctatattcgcatgtatgtgctttgaagaatttctcctcttactcctacttgatctaaaacattatttttcttttgggttt

SEQ ID NO: 199 - protein, 252 aa, Arabidopsis thaliana
  G142 Amino Acid Sequence
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 200 - DNA, 1839 bp, Arabidopsis thaliana
  G142 Genomic Sequence
atgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttgggtatatatatctttgctcctttgaaccaacttttgtgctatatatattaagattcatccaataaagctatgttttttatatgaaaattgattaataaatgggttcatttgctacttgttacatcgtacgattcaagagtcggatcatgttttgatcttgtggttattcttaatggttgtatcgtttatcctgtggtaattagggttcatcgttatatcgtgtctccctcttggatcctttatcataagctaataggtccttccgtacgttataatttgttgatttcccattcatgaattcctttgattctttaatcttacagatgacaggtttcaaatgggtttaattctagctttaaaaaaaaaaaaaacaaacaaactagggttttcccttttagatcagtgtgtaagatatataacttgagttcttgtcgtaagaagaatctttatttgttgaatcgagctaatgatctcccatttttgttttaattgaatttgtagaattgaaagcacaatcgaacggtataatcgttgttacaactgctctctaagcaataataagcctgaagagactacacaggcaagtgtgtgtacgtactttgaatatatttacaattattgtttctgatgataatgattctagctaactctattttctcaaattctcatgttactatatatatgcatttcatataatctatatggtgcagagttggtgtcaggaggtgacaaagcttaaatccaaatacgaatctcttgttcgtactaacaggtctagtaattaagagttttctataaccccttgaaattaaatcgttattgtcatcttccattatatatgtatagttacaaatctattgttatgggtgttgataattgctaattataaaaggaatttgcttggagaagatcttggagaaatgggtgtgaaggaactgcaagcgctcgagaggcagctcgaagccgctcttaccgcgactcgacagcgcaaggtcacatgatctagactggtcttgtttcattaaaaatatattcataactaaaacattcaactaaaatatgcagacacaagttatgatggaagaaatggaagaccttaggaaaaaggcaagttatataaaaatgtttcataccaaactgcaaaacatatatgcatatcaatcaatctatgtttgaaatggcaggagaggcaactaggagacataaacaaacaactcaagattaaggtttttatttctagacatcgcaaaattatattataacttctcatataattaattatgacatttggatcttaactaaacataaattttcaatagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtaagaatataccatttttcccggcccttacaaataaatggatagaaataagatatgattataagacttgtttggtatttggattaggtttcaacaacattactacgtgcaaggtgaagggtcttcggtatcaaagagtaacgtggcaggtgagactaatttcgtccaaggttgggttctttga

SEQ ID NO: 201 - DNA, 1839 bp, Arabidopsis thaliana; identical to SEQ ID NO: 200
  G142 DNA sequence used for BLAST

SEQ ID NO: 202 - DNA, 914 bp, Arabidopsis thaliana
  G148 cDNA Sequence
aaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcggagttggcagaaccattgagaggtactatcgctgtaaagacaatcttttggacaatgatacgcttgaagatactcagggcttgcgtcaagaggtgacaaagctcaaatgcaaatacgaatctcttcttcgcactcataggaatttggttggggaagatcttgaagggatgagtataaaggaattgcagacgctggagagacagcttgaaggagctctttccgcaacccgaaaacaaaagacgcaggttatgatggaacaaatggaagagcttcggagaaaggagagggagctcggagatataaacaataagctaaagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcgtttaggtcatttactatcgggacatactcttttttttttttttttctttttttttttcacaagacatactcttttctttaatttcaattatttgttagagttctcgtt

SEQ ID NO: 203 - protein, 244 aa, Arabidopsis thaliana
  G148 Amino Acid Sequence
MGRGKVEVKRIENKITRQVTFSKRKSGLLKKAYELSVLCDAEVSLIIFSTGGKLYEFSNVGVGRTIERYYRCKDNLLDNDTLEDTQGLRQEVTKLKCKYESLLRTHRNLVGEDLEGMSIKELQTLERQLEGALSATRKQKTQVMMEQMEELRRKERELGDINNKLKLETEDHDFKGFQDLLLNPVLTAGCSTDFSLQSTHQNYISDCNLGYFLQIGFQQHYEQGEGSSVTKSNARSDAETNFVQ

SEQ ID NO: 204 - DNA, 2053 bp, Arabidopsis thaliana
  G148 Genomic Sequence
atgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcgggtacgtatatccattcattcaagatcattaattcggttttcctaatgatgaaaacctaggttttcatgggtaatatgattaagatcatccatgtttgatttgtgtctgttcttaagatcaagaaaccaaattctgtcttgtgggtatctgaaaaaggttatgtctttttattctaaccctaactagttaaggttgatcaccatccatcgatctctcaggatccatcggacatatgggtcagtttagcttttagatccggtaaatcttttgaaagaaaacttctttgttttattttgggttttaattgttatcaccagctttgatatgtgtatgtccttaagatccatgaaacctcatatatacgttttgcctctttaaatagatatgtctttctaattctaattagagaaattaattagggtttatcatgggtagccgtagatctataatccattacgcagatatatcttcccagagatttttgtgtaattagaatttcctttagacatgcattaaaagttaacacagaacttaaggttttcgttctttggttttgaatttaagcaaattcagattattaattaaaatatcttgtggtttcttttgttttataaactgtagagttggcagaaccattgagaggtactatcgctgtaaagacaatcttttggacaatgatacgcttgaagatactcaggtcaatcattttttttcttaagtatgttcattttatctttatatatatacgaaatttgacctttgttcattctaagtgtatacatagtcaaactaactattatattataacgatgtataaaataaatagagctaagataaattgtagttaatcttctgctttttggtgcagggcttgcgtcaagaggtgacaaagctcaaatgcaaatacgaatctcttcttcgcactcataggtttaactaatcgtactcctcgtaatccattacttcctataattgtacatttcctaatttctgctactaataatcgttttgaatcgttgaaaaaggaatttggttggggaagatcttgaagggatgagtataaaggaattgcagacgctggagagacagcttgaaggagctctttccgcaacccgaaaacaaaaggcatgacatatttcatacgtagaccaatttttcttgcgcatcatttagacctgcaaaatacattattgaaatgtatatctttatatgcatgtatgtatatagacgcaggttatgatggaacaaatggaagagcttcggagaaaggcaagtactcgaaatgatgttctacaatatatgcatgcattgtatgtaaatgtactcatgtgtatatcatttttgtatttggaatggcaggagagggagctcggagatataaacaataagctaaaggttaatgtttttaactggacatccaaattatatatcaagtctttcttagttactatgattttgtgttagttaattagtgtattgtctactcataaatcttataaaatggataatcttcataatcagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtacgtaataatcgatatttttgcttctctactgatgaaatacaagtcatggttttatgaataaatttggccttattggatacatatataatatgaatatgatacatatgtaggtttcaacaacactatgagcaaggtgaaggatcttcggtgacaaagagtaatgcaagaagtgatgctgagaccaactttgtccaatga

SEQ ID NO: 205 - DNA, 2053 bp, Arabidopsis thaliana
  G148 DNA sequence used for BLAST
tcattggacaaagttggtctcagcatcacttcttgcattactctttgtcaccgaagatccttcaccttgctcatagtgttgttgaaacctacatatgtatcatattcatattatatatgtatccaataaggccaaatttattcataaaaccatgacttgtatttcatcagtagagaagcaaaaatatcgattattacgtacccaatctgtaaaaaatatccaaggttgcaatccgatatataattttgatgagttgattgcaaggaaaaatcagtggaacaaccggcggtgagcaccgggttaagcagtaggtcttgaaagcctttaaaatcatgatcttctgtctcaagctgattatgaagattatccattttataagatttatgagtagacaatacactaattaactaacacaaaatcatagtaactaagaaagacttgatatataatttggatgtccagttaaaaacattaacctttagcttattgtttatatctccgagctccctctcctgccattccaaatacaaaaatgatatacacatgagtacatttacatacaatgcatgcatatattgtagaacatcatttcgagtacttgcctttctccgaagctcttccatttgttccatcataacctgcgtctatatacatacatgcatataaagatatacatttcaataatgtattttgcaggtctaaatgatgcgcaagaaaaattggtctacgtatgaaatatgtcatgccttttgttttcgggttgcggaaagagctccttcaagctgtctctccagcgtctgcaattcctttatactcatcccttcaagatcttccccaaccaaattcctttttcaacgattcaaaacgattattagtagcagaaattaggaaatgtacaattataggaagtaatggattacgaggagtacgattagttaaacctatgagtgcgaagaagagattcgtatttgcatttgagctttgtcacctcttgacgcaagccctgcaccaaaaagcagaagattaactacaatttatcttagctctatttattttatacatcgttataatataatagttagtttgactatgtatacacttagaatgaacaaaggtcaaatttcgtatatatataaagataaaatgaacatacttaagaaaaaaaatgattgacctgagtatcttcaagcgtatcattgtccaaaagattgtctttacagcgatagtacctctcaatggttctgccaactctacagtttataaaacaaaagaaaccacaagatattttaattaataatctgaatttgcttaaattcaaaaccaaagaacgaaaaccttaagttctgtgttaacttttaatgcatgtctaaaggaaattctaattacacaaaaatctctgggaagatatatctgcgtaatggattatagatctacggctacccatgataaaccctaattaatttctctaattagaattagaaagacatatctatttaaagaggcaaaacgtatatatgaggtttcatggatcttaaggacatacacatatcaaagctggtgataacaattaaaacccaaaataaaacaaagaagttttctttcaaaagatttaccggatctaaaagctaaactgacccatatgtccgatggatcctgagagatcgatggatggtgatcaaccttaactagttagggttagaataaaaagacataacctttttcagatacccacaagacagaatttggtttcttgatcttaagaacagacacaaatcaaacatggatgatcttaatcatattacccatgaaaacctaggttttcatcattaggaaaaccgaattaatgatcttgaatgaatggatatacgtacccgacattgctgaactcgtagagcttgccaccggtggagaagattatgagagaaacctctgcatcacaaagaacagagagttcgtaggctttcttgagcaaaccactttttcttttggagaaggttacttgtctagtgatcttgttctcaattctcttcacttccactttgcctcttcccat

SEQ ID NO: 206 - DNA, 959 bp, Arabidopsis thaliana
  G152 cDNA Sequence
cctagaacgcaccaagatctaaaggaagatcaaaatagggtttaaattaatggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccagtgtgaaatctactattgaacgattcaatacggctaagatggaggagcaagaactaatgaaccctgcatcagaagttaagttttggcagagagaggctgaaactctaaggcaagaattgcactcattgcaagaaaattatcggcaactaacgggagtggaattaaatggtttgagcgttaaggagttacaaaacatagagagtcaacttgaaatgagtttacgtggaattcgtatgaaaagggaacaaattttgaccaatgaaattaaagagctaaccagaaagaggaatcttgttcatcatgaaaacctcgaattgtcgagaaaagtacaaaggattcatcaagaaaatgtcgaactatacaagaaggcttatggaacgtcgaacacaaatggattgggacatcatgagctagtagatgcagtttatgaatcccatgcacaggttaggctgcagctaagccagcctgagcagtcccattataagacatcttcaaacagctaagatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagctt

SEQ ID NO: 207 - protein, 227 aa, Arabidopsis thaliana
  G152 Amino Acid Sequence
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 208 - DNA, 3269 bp, Arabidopsis thaliana
  G152 Genomic Sequence
atggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccaggtttctctcttcctttattcaattcttagatcttttaacatctacatacctatagatctacatctatctatgtatttgtatatctataataaatggaactatatataggtatgtacgtacttatataatatcatgtgtgggttcactacaagaatataggctatttctctaagagggtttggattaattcaatgatttgtgtttggtagcgtgcatttagtcatttgtagtagtatacatttttctgcatcttgtggcgataacgctctctatatttctgtgtatatatacaaggtgataaatgtatgagctaaggaaacttaattttcaaaggaaacttagtttgaaaggagcttaggatgccaaagcaaaagaaaactaattaaagacgatgactagtgtaaagatgaaaacacacactaatttgaagtaggctcatggcagtgtgtggacatgtgtgtcattggttgtaaattgtgtatgtggctgacagtgtgtctttgccaaatttagaaacatttgagtagagaagatagtaattaaagctaaaaacaagtataacgttggaaaactgaaagagtgataaatgggagtgtataagatatcactacaatcaattgtgcatttttaaggatatatcatacatttggagatgatatatgtaaactgataaaaaaattacccatctacttgtatataagcatataaatctcaatattttgtatatatgaaactacccaagaacgataagatgactatgtattttaaaccataaatgactgcacaatttattatgacaaaattttgaagtattacatgagaatttttttttttcgtttcagattttccaaatgtgaagtattcatatttacttttgaagatcaaatttatcatgtgtaaaagaatcttatatatgtataaatcatcgtgaatccatttcctgacctatatatatatatatatcatatttttcttatgtgataaaaatataaagccttcttaataattttaaagattgtgaaaaaaaatcaaggaagtgatggattttgtttttcttttcattagaaaataattttattttgccacaaggaagcaaacattatgaaatgcttataagttgaaattcttaaaatgaacagtgtgaaatctactattgaacgattcaatacggctaagatggaggagcaagaactaatgaaccctgcatcagaagttaaggtacgtataacagaaatcacgcagcacataagaggggaaggcaattattagttaatatcttaatcatgtgtttgtattactatgcttgagtttgagagttgatcgagttagattgtgttgcgtgttgtagttttggcagagagaggctgaaactctaaggcaagaattgcactcattgcaagaaaattatcggtatgtatttgttcataaactacaaaactatgagtaatcatgtgtttctaactccaaagtaagaagtactgatcttaattgtatcctttttgctaagagttgatcttttctcacatgatttctaactaaaacttttctctttctaattatttttgtttaaaactgttcagccaaaatttgtgcatttaacataataaggtaacaaaatggatgttatgcgcctaatatgtttaaaacaatgtatatatacttcatcgagtcgattagagaaagcggattaatcctaaaaaatttgcacaattgagactaactttaactttgcactaccagatttaataaccccacactctatcatttttctttaaaaaaattatttcaagaatgatagatttggaaccaattagttcatacctagtttcaatggtgtaatctcatgaagattcatccgttctctttaatctactcgatgagattaattttctttgaattaaattttgttattttttgctttcaagtattttccgtttaatctacattctagtactatactccggacctctagcattttatttctaaaattttctatgtaaactttttcctccggattgtacaaccaatcacttatgtgtttaagggtaagaaaaatatgtatatgttgaaaactcgaccatgattgttctgtcggactggttcatttctgaaattagtcgagcggattaaattggttgtagttggccatgtccgttctacatatattaactgcagtaatgttttgtgataaatcaggcaactaacgggagtggaattaaatggtttgagcgttaaggagttacaaaacatagagagtcaacttgaaatgagtttacgtggaattcgtatgaaaagggtaatatatgaatgctctaggcctctagctggttcgcatgatgcttaaaaattgataatagagcattgaagtttaagctaattattcttttcgaaccttgcaggaacaaattttgaccaatgaaattaaagagctaaccagaaaggtaaactatatgatataacacatgattattaaaaatcagactcggatgttgttgtttgtgtttacattgtaaacacacataatttgcagatgtaaaatgcaaacgatatttttagtttcttcttcggtttgtgtttgcatttgcaatttacaaaaaaatctgttctttgagaaaagatactaaagatgttgtgtttaagtttgaaacgcattattaatcaatgttatcatttctagttttcaggttcttataagtgttttatcttttgcagaggaatcttgttcatcatgaaaacctcgaattgtcgagaaaagtacaaaggattcatcaagaaaatgtcgaactatacaagaaggtaaaatagaaacacaaacttcattacttcaagttgcagctaacaaatcctttaaatcaaattaatctcctagttgaaactagacaaatctcaataattaattattgagatcgtacgtagttacaaaagtgtgttgtggtaatggtcttgcatacaggcttatggaacgtcgaacacaaatggattgggacatcatgagctagtagatgcagtttatgaatcccatgcacaggttaggctgcagctaagccagcctgagcagtcccattataagacatcttcaaacagcta

SEQ ID NO: 209 - DNA, 3270 bp, Arabidopsis thaliana
  G152 DNA sequence used for BLAST
atggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccaggtttctctcttcctttattcaattcttagatcttttaacatctacatacctatagatctacatctatctatgtatttgtatatctataataaatggaactatatataggtatgtacgtacttatataatatcatgtgtgggttcactacaagaatataggctatttctctaagagggtttggattaattcaatgatttgtgtttggtagcgtgcatttagtcatttgtagtagtatacatttttctgcatcttgtggcgataacgctctctatatttctgtgtatatatacaaggtgataaatgtatgagctaaggaaacttaattttcaaaggaaacttagtttgaaaggagcttaggatgccaaagcaaaagaaaactaattaaagacgatgactagtgtaaagatgaaaacacacactaatttgaagtaggctcatggcagtgtgtggacatgtgtgtcattggttgtaaattgtgtatgtggctgacagtgtgtctttgccaaatttagaaacatttgagtagagaagatagtaattaaagctaaaaacaagtataacgttggaaaactgaaagagtgataaatgggagtgtataagatatcactacaatcaattgtgcatttttaaggatatatcatacatttggagatgatatatgtaaactgataaaaaaattacccatctacttgtatataagcatataaatctcaatattttgtatatatgaaactacccaagaacgataagatgactatgtattttaaaccataaatgactgcacaatttattatgacaaaattttgaagtattacatgagaatttttttttttcgtttcagattttccaaatgtgaagtattcatatttacttttgaagatcaaatttatcatgtgtaaaagaatcttatatatgtataaatcatcgtgaatccatttcctgacctatatatatatatatatcatatttttcttatgtgataaaaatataaagccttcttaataattttaaagattgtgaaaaaaaatcaaggaagtgatggattttgtttttcttttcattagaaaataattttattttgccacaaggaagcaaacattatgaaatgcttataagttgaaattcttaaaatgaacagtgtgaaatctactattgaacgattcaatacggctaagatggaggagcaagaactaatgaaccctgcatcagaagttaaggtacgtataacagaaatcacgcagcacataagaggggaaggcaattattagttaatatcttaatcatgtgtttgtattactatgcttgagtttgagagttgatcgagttagattgtgttgcgtgttgtagttttggcagagagaggctgaaactctaaggcaagaattgcactcattgcaagaaaattatcggtatgtatttgttcataaactacaaaactatgagtaatcatgtgtttctaactccaaagtaagaagtactgatcttaattgtatcctttttgctaagagttgatcttttctcacatgatttctaactaaaacttttctctttctaattatttttgtttaaaactgttcagccaaaatttgtgcatttaacataataaggtaacaaaatggatgttatgcgcctaatatgtttaaaacaatgtatatatacttcatcgagtcgattagagaaagcggattaatcctaaaaaatttgcacaattgagactaactttaactttgcactaccagatttaataaccccacactctatcatttttctttaaaaaaattatttcaagaatgatagatttggaaccaattagttcatacctagtttcaatggtgtaatctcatgaagattcatccgttctctttaatctactcgatgagattaattttctttgaattaaattttgttattttttgctttcaagtattttccgtttaatctacattctagtactatactccggacctctagcattttatttctaaaattttctatgtaaactttttcctccggattgtacaaccaatcacttatgtgtttaagggtaagaaaaatatgtatatgttgaaaactcgaccatgattgttctgtcggactggttcatttctgaaattagtcgagcggattaaattggttgtagttggccatgtccgttctacatatattaactgcagtaatgttttgtgataaatcaggcaactaacgggagtggaattaaatggtttgagcgttaaggagttacaaaacatagagagtcaacttgaaatgagtttacgtggaattcgtatgaaaagggtaatatatgaatgctctaggcctctagctggttcgcatgatgcttaaaaattgataatagagcattgaagtttaagctaattattcttttcgaaccttgcaggaacaaattttgaccaatgaaattaaagagctaaccagaaaggtaaactatatgatataacacatgattattaaaaatcagactcggatgttgttgtttgtgtttacattgtaaacacacataatttgcagatgtaaaatgcaaacgatatttttagtttcttcttcggtttgtgtttgcatttgcaatttacaaaaaaatctgttctttgagaaaagatactaaagatgttgtgtttaagtttgaaacgcattattaatcaatgttatcatttctagttttcaggttcttataagtgttttatcttttgcagaggaatcttgttcatcatgaaaacctcgaattgtcgagaaaagtacaaaggattcatcaagaaaatgtcgaactatacaagaaggtaaaatagaaacacaaacttcattacttcaagttgcagctaacaaatcctttaaatcaaattaatctcctagttgaaactagacaaatctcaataattaattattgagatcgtacgtagttacaaaagtgtgttgtggtaatggtcttgcatacaggcttatggaacgtcgaacacaaatggattgggacatcatgagctagtagatgcagtttatgaatcccatgcacaggttaggctgcagctaagccagcctgagcagtcccattataagacatcttcaaacagctaa

SEQ ID NO: 210 - DNA, 883 bp, Arabidopsis thaliana; identical to SEQ ID NO: 85
  G157 cDNA Sequence

SEQ ID NO: 211 - protein, 196 aa, Arabidopsis thaliana
  G157 Amino Acid Sequence
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 212 - DNA, 4166 bp, Arabidopsis thaliana
  G157 Genomic Sequence
atgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgagtaagaagatactttccttttctgggtctcactcgatttttgtgcttttttactttgtttaattactttctccatatagaagcttcaaatctagggctttttgattccatcaaatcaactgagattttctccttgttttctgtatgaagatagcagatgcgtaagctttaacctaatttaagactaaacattttgatcgccaagatatgttcttgatgttcgtttcgtgttttttttttcgtgtttttttttttttcattttaaaatcatttttatctctttttttaccttcatttgtgacgaaatttaatattgcatgttattcaagaaacttttctacacgtggtgattcgttcttgatgttgtttaagtaatctttgtattgctagttccatctgttgttcactttgaagcttcgttttttcatataagaaacaatatgtttagattgttcaaattttgagatttggtaattatattcaatattgcaatgcacttcaagtagttttgttgagagattatttggggttagtggtaacattaatcgaatatctttggttcaaattggttaacacattgtactttatgttgatccaaaatgtattgtagatcttttcttttgtaattctctttaaggaataaggtttatctagttgattttgatggtttattgtagtgctgggataagtttccacattgatactcgccacacattcttcattacttaactaattggatatcgattttaacccttttaatcgtaatttgttgtgtgtttatgacaccatacaagatacattatgtcttactgagtgactctttgttgctctctaagatgttgtagtttggatttctttgctaaagaaactcaaactataactgattttactgctaccatatatatgtcagtggcctagtaggttcattaagtagaaatcggtcgccaattttactaattgggagaaaccactagactacaaccaaatgttcaatgactttaatagtcttctgttatttgtcgtggatatttttaaccccatgaacttttgtatctagaaaaatctcatccacttctcttttagaatactttgaatgcgactaaaagtgagttttttttttctaatagacctaagataaaatcatcaatggataagtaggaaatggaaaggtaactcttgtcagtatgtgtatatatacagctccttctcatttccttgatgttgactccataaatgcttgatcatgaaagcaaatttgttaaatttgtaaccaacaaaatgcacagactatagacgaagtattaggaaccgtatctatctgtctccattttacaatagtcaagctctagttgtagctagtttctttatttagttcttataccttaacaaagtggcactatgcaaagtgtttttagttgagattagtcgtcttatgcgtcttactaattgttcattttttcttctttttgtgattgatgtaaaattactaagtcacaacttgagatgttactaaaaagataagaacgtgtaataactgaagtgaatttgaagccagtctctattcatatcatagcattaatagatcatggacaacacatatataggattagagctgtcatgaccttcccggaaatgctaaatcagtttcttggtttatcctttttggagtatcatgatatcatttagccaaaggtttttggtttcagtattccgattcgtttgacgttatgtgtgaaagcgtcaataactaaaacttggattgactagtcaaaatataaactgattgcattgaattcttgaaaattttcccttaaaatgaacatgaatttcatcaagattttgtcttttggaaggatgtgatttataatctatacaatcatacattttgcatgatattagttttttgaagaaccaaaaatagagcttctttataaaactgatttagccttgataagaaaaagaaggtagataatcgaactcatggggatgagttaaaaatgtgtgcacttagtttctaaaaccttttgaagtcgaaacaatgacaatattggctgcgaagttgatatataacaggatcttaaagttgaaattgtaaattcagattttaattttagagcaccagatgatcagagtttcagatttacatttgaagtataaaacattttgaacacatatatctaaagcagtaacttcaaaaatagggtaactaatagtaacttacattgttttttttaatgcttttatacttactatcatttttatatatagatgcctggttaagtaaagatgattatcaaaaactgttggttagtaacagaaattgttgcaaatgtaacatattatataagctttctttcactttggtgcattctctctaaataatggcctctattgatgcagtatctgattcttagttttgaaatggtttttgcataaattattgttctaatgcatttttgttttatctccagcatttccaagatcattgatcgttatgaaatacaacatgctgatgaacttagagccttagtaagtaattagctaagaacgtcattctaatattcttctggatgcggtttttggtgttatgaaggatagaagcgctgttcaagccggagaaacctcaatgttttgaactcgtaacaccgaacttaattctctagagttacagttattgtgtctactggaaaatacaagaacttcacaatctttctgaccattccttttcttcatgtgcaggatcttgaagaaaaaattcagaattatcttccacacaaggagttactagaaacagtccaaaggttagcagtacgacacatttttctcccctcttcttctgataaaaaaaatgttttttttcttttgtctacttgtgaatacagcaagcttgaagaaccaaatgtcgataatgtaagtgtagattctctaatttctctggaggaacaacttgagactgctctgtccgtaagtagagctaggaaggtatatgtgctgctactaagtgattcaaccaattactccacaaaaccttctttttagttagttatcctagaacaatcttttgacataaatcttaatgtcttgttataggcagaactgatgatggagtatatcgagtcccttaaagaaaaggttagtgctttggtttttattttcgataaaggccatattctaggctatgatgattcttgaattctattaacctgctgagtctacagattactatatatatatatatatatcttttggtcttgtcttagttcctgatttagtattggcttcattcaggtgaaaccctaatgagaattaaaaaaacaagcagttttaaactcttgatcaaatccaacctttccctcataaagtgtcgaatttggatgaggatgatttatgtttcgagaaggaaacatgtttggaaatagctatagaagttgttagaaactaatgaccttatgatcttttccaaacaggagaaattgctgagagaagagaaccaggttctggctagccaggtaacaatgaccacaatatcttctgctcttgaagctaattaatcactttatacgtccccgttatagagagatacacatatacacgtacatgaaaactaaaagttgaaggactttgatggatactagacaattatagtgaaaccctaaatatgtgataagtgataacaaaatgcttttaaaatctatctttcttgttaatttagtagctgtcagagaagaaaggtatgtctcaccgatgaaagatactcaaaacccggtatttttaatttgtgaaatttgcaaataaaaaaaatgctttctacaagatagattaatttcttgcaatgtttagtagctgtagaaaaaaaagaaatgtaagaaagtttcttacagatgggaaagaatacgttgctggcaacagatgatgagagaggaatgtttccgggaagtagctccggcaacaaaataccggagactctcccgctgctcaatta

SEQ ID NO: 213 - DNA, 4167 bp, Arabidopsis thaliana
  G157 DNA sequence used for BLAST
atgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgagtaagaagatactttccttttctgggtctcactcgatttttgtgcttttttactttgtttaattactttctccatatagaagcttcaaatctagggctttttgattccatcaaatcaactgagattttctccttgttttctgtatgaagatagcagatgcgtaagctttaacctaatttaagactaaacattttgatcgccaagatatgttcttgatgttcgtttcgtgttttttttttcgtgtttttttttttttcattttaaaatcatttttatctctttttttaccttcatttgtgacgaaatttaatattgcatgttattcaagaaacttttctacacgtggtgattcgttcttgatgttgtttaagtaatctttgtattgctagttccatctgttgttcactttgaagcttcgttttttcatataagaaacaatatgtttagattgttcaaattttgagatttggtaattatattcaatattgcaatgcacttcaagtagttttgttgagagattatttggggttagtggtaacattaatcgaatatctttggttcaaattggttaacacattgtactttatgttgatccaaaatgtattgtagatcttttcttttgtaattctctttaaggaataaggtttatctagttgattttgatggtttattgtagtgctgggataagtttccacattgatactcgccacacattcttcattacttaactaattggatatcgattttaacccttttaatcgtaatttgttgtgtgtttatgacaccatacaagatacattatgtcttactgagtgactctttgttgctctctaagatgttgtagtttggatttctttgctaaagaaactcaaactataactgattttactgctaccatatatatgtcagtggcctagtaggttcattaagtagaaatcggtcgccaattttactaattgggagaaaccactagactacaaccaaatgttcaatgactttaatagtcttctgttatttgtcgtggatatttttaaccccatgaacttttgtatctagaaaaatctcatccacttctcttttagaatactttgaatgcgactaaaagtgagttttttttttctaatagacctaagataaaatcatcaatggataagtaggaaatggaaaggtaactcttgtcagtatgtgtatatatacagctccttctcatttccttgatgttgactccataaatgcttgatcatgaaagcaaatttgttaaatttgtaaccaacaaaatgcacagactatagacgaagtattaggaaccgtatctatctgtctccattttacaatagtcaagctctagttgtagctagtttctttatttagttcttataccttaacaaagtggcactatgcaaagtgtttttagttgagattagtcgtcttatgcgtcttactaattgttcattttttcttctttttgtgattgatgtaaaattactaagtcacaacttgagatgttactaaaaagataagaacgtgtaataactgaagtgaatttgaagccagtctctattcatatcatagcattaatagatcatggacaacacatatataggattagagctgtcatgaccttcccggaaatgctaaatcagtttcttggtttatcctttttggagtatcatgatatcatttagccaaaggtttttggtttcagtattccgattcgtttgacgttatgtgtgaaagcgtcaataactaaaacttggattgactagtcaaaatataaactgattgcattgaattcttgaaaattttcccttaaaatgaacatgaatttcatcaagattttgtcttttggaaggatgtgatttataatctatacaatcatacattttgcatgatattagttttttgaagaaccaaaaatagagcttctttataaaactgatttagccttgataagaaaaagaaggtagataatcgaactcatggggatgagttaaaaatgtgtgcacttagtttctaaaaccttttgaagtcgaaacaatgacaatattggctgcgaagttgatatataacaggatcttaaagttgaaattgtaaattcagattttaattttagagcaccagatgatcagagtttcagatttacatttgaagtataaaacattttgaacacatatatctaaagcagtaacttcaaaaatagggtaactaatagtaacttacattgttttttttaatgcttttatacttactatcatttttatatatagatgcctggttaagtaaagatgattatcaaaaactgttggttagtaacagaaattgttgcaaatgtaacatattatataagctttctttcactttggtgcattctctctaaataatggcctctattgatgcagtatctgattcttagttttgaaatggtttttgcataaattattgttctaatgcatttttgttttatctccagcatttccaagatcattgatcgttatgaaatacaacatgctgatgaacttagagccttagtaagtaattagctaagaacgtcattctaatattcttctggatgcggtttttggtgttatgaaggatagaagcgctgttcaagccggagaaacctcaatgttttgaactcgtaacaccgaacttaattctctagagttacagttattgtgtctactggaaaatacaagaacttcacaatctttctgaccattccttttcttcatgtgcaggatcttgaagaaaaaattcagaattatcttccacacaaggagttactagaaacagtccaaaggttagcagtacgacacatttttctcccctcttcttctgataaaaaaaatgttttttttcttttgtctacttgtgaatacagcaagcttgaagaaccaaatgtcgataatgtaagtgtagattctctaatttctctggaggaacaacttgagactgctctgtccgtaagtagagctaggaaggtatatgtgctgctactaagtgattcaaccaattactccacaaaaccttctttttagttagttatcctagaacaatcttttgacataaatcttaatgtcttgttataggcagaactgatgatggagtatatcgagtcccttaaagaaaaggttagtgctttggtttttattttcgataaaggccatattctaggctatgatgattcttgaattctattaacctgctgagtctacagattactatatatatatatatatatcttttggtcttgtcttagttcctgatttagtattggcttcattcaggtgaaaccctaatgagaattaaaaaaacaagcagttttaaactcttgatcaaatccaacctttccctcataaagtgtcgaatttggatgaggatgatttatgtttcgagaaggaaacatgtttggaaatagctatagaagttgttagaaactaatgaccttatgatcttttccaaacaggagaaattgctgagagaagagaaccaggttctggctagccaggtaacaatgaccacaatatcttctgctcttgaagctaattaatcactttatacgtccccgttatagagagatacacatatacacgtacatgaaaactaaaagttgaaggactttgatggatactagacaattatagtgaaaccctaaatatgtgataagtgataacaaaatgcttttaaaatctatctttcttgttaatttagtagctgtcagagaagaaaggtatgtctcaccgatgaaagatactcaaaacccggtatttttaatttgtgaaatttgcaaataaaaaaaatgctttctacaagatagattaatttcttgcaatgtttagtagctgtagaaaaaaaagaaatgtaagaaagtttcttacagatgggaaagaatacgttgctggcaacagatgatgagagaggaatgtttccgggaagtagctccggcaacaaaataccggagactctcccgctgctcaattag

SEQ ID NO: 214 - DNA, 1133 bp, Arabidopsis thaliana
  misc_feature (1131)..(1131): n is a, c, g, or t
  G161 cDNA Sequence
tatattttagcttctcaaatatcactaaaaatggtgaaaaaaagcaaaggtcgtcaaaaaatagagatggtcaaaatgaaaaatgaaagtaaccttcaagttactttttcaaaaagaagatctggacttttcaaaaaggctagtgagctttgcacactttgtggtgcagaagtggccatagttgtgttctcacctggtcgaaaagtcttttcttttggtcatccaaatgttgattctgtaattgatcgattcataaacaataaccctctacctcctcaccaacacaacaacatgcaacttagagaaactcgtcgaaattcgattgttcaggatctgaataatcatcttactcaggtgttgagtcaattagaaacagagaaaaagaagtacgacgagttaaagaaaataagagaaaagacaaaagcccttgggaattggtgggaagatcccgttgaggaacttgcgttatctcaactcgaggggttcaaaggtaatcttgaaaatttgaagaaagtagttacagtcgaagcttccagattttttcaggcaaatgttccaaacttctatgtgggaagttctagtaataatgctgcttttgggattgatgatggtagtcatatcaaccctgatatggatctctttagccaaagaagaatgatggacataaatgccttcaactacaaccagaaccaaattcaccctaatcatgcattaccaccctttggaaacaatgcttatggtattaatgaagggtttgttccagaatacaatgtgaacttcagaccagagtataacccaaaccaaaaccaaatccaaaaccaaaatcaagttcaaatccaaatccaaaaccagagttttaagagagaaaacatctctgaatatgaacatcatcatggttatcctccccagtctagatctgattactattaaccctttgttgtgtgatccaacttaagtctctagacaaaaagttgtgtgtttaggttatctttatttcttcttatttatgtttctacatgtgttgttgttgtttttcttgttcttgtttaagtattatgttgtattgtgttgtttcatttcaaaattatgttattgctatatataaattatatgtgtcggaaacaaaaaaanaa

SEQ ID NO: 215 - protein, 299 aa, Arabidopsis thaliana
  G161 Amino Acid Sequence
MVKKSKGRQKIEMVKMKNESNLQVTFSKRRSGLFKKASELCTLCGAEVAIVVFSPGRKVFSFGHPNVDSVIDRFINNNPLPPHQHNNMQLRETRRNSIVQDLNNHLTQVLSQLETEKKKYDELKKIREKTKALGNWWEDPVEELALSQLEGFKGNLENLKKVVTVEASRFFQANVPNFYVGSSSNNAAFGIDDGSHINPDMDLFSQRRMMDINAFNYNQNQIHPNHALPPFGNNAYGINEGFVPEYNVNFRPEYNPNQNQIQNQNQVQIQIQNQSFKRENISEYEHHHGYPPQSRSDYY

SEQ ID NO: 216 - DNA, 1192 bp, Arabidopsis thaliana
  G161 Genomic Sequence
atggtgaaaaaaagcaaaggtcgtcaaaaaatagagatggtcaaaatgaaaaatgaaagtaaccttcaagttactttttcaaaaagaagatctggacttttcaaaaaggctagtgagctttgcacactttgtggtgcagaagtggccatagttgtgttctcacctggtcgaaaagtcttttcttttggtcatccaaatgttgattctgtaattgatcgattcataaacaataaccctctacctcctcaccaacacaacaacatgcaacttagagaaactcgtcgaaattcgattgttcaggatctgaataatcatcttactcaggtaatcttactcttatttttaagtatgattaaaacaaaatagtgttttctatgaatcataaaacccaaatttctatggttaaattctttttttatttaatatatataagtaaaagttttcgcaggtgaataaataatatataaaaaacattagacagtctttttctccataactagaatagatttatatcctaatagtatgttagataaaaatgccgatgaaatgttatagaatcatatggtatgaaaattaataatattattggtgtttttatttgtatatatatttgcaggtgttgagtcaattagaaacagagaaaaagaagtacgacgagttaaagaaaataagagaaaagacaaaagcccttgggaattggtgggaagatcccgttgaggaacttgcgttatctcaactcgaggggttcaaaggtaatcttgaaaatttgaagaaagtagttacagtcgaagcttccagattttttcaggcaaatgttccaaacttctatgtgggaagttctagtaataatgctgcttttgggattgatgatggtagtcatatcaaccctgatatggatctctttagccaaagaagaatgatggacataaatgccttcaactacaaccagaaccaaattcaccctaatcatgcattaccaccctttggaaacaatgcttatggtattaatgaagggtttgttccagaatacaatgtgaacttcagaccagagtataacccaaaccaaaaccaaatccaaaaccaaaatcaagttcaaatccaaatccaaaaccagagttttaagagagaaaacatctctgaatatgaacatcatcatggttatcctccccagtctagatctgattactattaa

SEQ ID NO: 217 - DNA, 1192 bp, Arabidopsis thaliana; identical to SEQ ID NO: 216
  G161 DNA sequence used for BLAST

SEQ ID NO: 218 - DNA, 928 bp, Arabidopsis thaliana
  G164 cDNA Sequence
aaatacacaaaagaaaaagataagagatatgagggggaagatgaagttatcgttcatagaaaatgattcagtgaggaaaacaacattcaccaaaaggaagaaagggatgctgaagaaattcaacgagctagtaactctatgtggtgttgacgcatgtgcggtcatccgtagcccgtacaactcgatccaggagccttggccatcaagggaaggcgttgaagaagtgatgtcgaagtttatggagttttcggtgttggaccggaccaagaagatggtggatcaagagacgtttttacgtcaaaggatcgccaaagaaacagaacgtctccagaagctacgtgatgagaaccgtaattctcagattcgagatttaatgtttggttgtctcaaaggagaggtggacgtgtctcatcttcatggaagagatcttcttgatttgaatgtatttcttaacaagtatctcaatggtgttattcgtagggttgagatccttaaggagaacggtgagtcttcttcatctgtacctcctcctattggtgtagctcctactgttgtggatgcatctgtcccaatcggttttgatggtcgtatgattcaagatcaaaaccaaaatcagcaagagccggttcaattccaataccaggctctttatgatttttatgatcagattccaaagaaacttcatgattttaacatgaaaatgaatatagatccaaatcagagtatgaatttggatcttaatgatggagaggacgagggcattccttgcatggacaacaacaactaccaccccgaaatcgattgtctcgctaccgtcaccactgcccccactgatgtttgtgctcctaacatcatcaatgatctctagtcgaagggatgtatttcgagtgaagtggttgatcatctgcatcttttgatttttccattt

SEQ ID NO: 219 - protein, 279 aa, Arabidopsis thaliana
  G164 Amino Acid Sequence
MRGKMKLSFIENDSVRKTTFTKRKKGMLKKFNELVTLCGVDACAVIRSPYNSIQEPWPSREGVEEVMSKFMEFSVLDRTKKMVDQETFLRQRIAKETERLQKLRDENRNSQIRDLMFGCLKGEVDVSHLHGRDLLDLNVFLNKYLNGVIRRVEILKENGESSSSVPPPIGVAPTVVDASVPIGFDGRMIQDQNQNQQEPVQFQYQALYDFYDQIPKKLHDFNMKMNIDPNQSMNLDLNDGEDEGIPCMDNNNYHPEIDCLATVTTAPTDVCAPNIINDL

SEQ ID NO: 220 - DNA, 840 bp, Arabidopsis thaliana
  G164 Genomic Sequence
atgagggggaagatgaagttatcgttcatagaaaatgattcagtgaggaaaacaacattcaccaaaaggaagaaagggatgctgaagaaattcaacgagctagtaactctatgtggtgttgacgcatgtgcggtcatccgtagcccgtacaactcgatccaggagccttggccatcaagggaaggcgttgaagaagtgatgtcgaagtttatggagttttcggtgttggaccggaccaagaagatggtggatcaagagacgtttttacgtcaaaggatcgccaaagaaacagaacgtctccagaagctacgtgatgagaaccgtaattctcagattcgagatttaatgtttggttgtctcaaaggagaggtggacgtgtctcatcttcatggaagagatcttcttgatttgaatgtatttcttaacaagtatctcaatggtgttattcgtagggttgagatccttaaggagaacggtgagtcttcttcatctgtacctcctcctattggtgtagctcctactgttgtggatgcatctgtcccaatcggttttgatggtcgtatgattcaagatcaaaaccaaaatcagcaagagccggttcaattccaataccaggctctttatgatttttatgatcagattccaaagaaacttcatgattttaacatgaaaatgaatatagatccaaatcagagtatgaatttggatcttaatgatggagaggacgagggcattccttgcatggacaacaacaactaccaccccgaaatcgattgtctcgctaccgtcaccactgcccccactgatgtttgtgctcctaacatcatcaatgatctctag

SEQ ID NO: 221 - DNA, 840 bp, Arabidopsis thaliana
  G164 DNA sequence used for BLAST
ctagagatcattgatgatgttaggagcacaaacatcagtgggggcagtggtgacggtagcgagacaatcgatttcggggtggtagttgttgttgtccatgcaaggaatgccctcgtcctctccatcattaagatccaaattcatactctgatttggatctatattcattttcatgttaaaatcatgaagtttctttggaatctgatcataaaaatcataaagagcctggtattggaattgaaccggctcttgctgattttggttttgatcttgaatcatacgaccatcaaaaccgattgggacagatgcatccacaacagtaggagctacaccaataggaggaggtacagatgaagaagactcaccgttctccttaaggatctcaaccctacgaataacaccattgagatacttgttaagaaatacattcaaatcaagaagatctcttccatgaagatgagacacgtccacctctcctttgagacaaccaaacattaaatctcgaatctgagaattacggttctcatcacgtagcttctggagacgttctgtttctttggcgatcctttgacgtaaaaacgtctcttgatccaccatcttcttggtccggtccaacaccgaaaactccataaacttcgacatcacttcttcaacgccttcccttgatggccaaggctcctggatcgagttgtacgggctacggatgaccgcacatgcgtcaacaccacatagagttactagctcgttgaatttcttcagcatccctttcttccttttggtgaatgttgttttcctcactgaatcattttctatgaacgataacttcatcttccccctcat

SEQ ID NO: 222 - DNA, 1398 bp, Arabidopsis thaliana
  G177 cDNA Sequence
aaaagtttccttttttagcgaatcctctgttttagaaatcttaaagttgtctcctttattaaagaccatcatgtcttccacttctttcaccgaccttcttggttcttccggcgttgactgttacgaagatgatgaagacttgagagtttctgggtcgagttttggtgggtactatccagagagaaccgggtctggtttacctaagttcaagacggctcaaccaccacctcttccgatttcacaatcttctcataacttcactttctccgattaccttgattctcctctgcttctcagctcctcacacagtttgatatctccaacaacaggaacgtttccattgcaaggctttaatggaacaacaaacaatcactcagattttccctggcagctacaatctcaaccatcaaacgcttcttctgctttgcaagaaacatatggtgttcaagatcacgagaagaagcaggagatgattcctaatgagattgcaacacaaaacaacaatcaaagttttggaacagaacgtcagataaagataccagcatacatggtgagtaggaactctaatgatggttatggttggagaaaatacggtcagaaacaagtgaagaagagcgaaaaccctaggagttacttcaagtgtacgtatcctgattgtgtttccaagaagattgttgagacggcttctgatggacagatcactgagatcatttataaaggtggtcataatcatcctaagcctgagttcaccaagagaccatctcaatcttcattaccatcatcggttaatgggaggcgcttgtttaatcctgcttctgttgttagtgaacctcatgatcaatcagagaactcttcgatttcgtttgactatagtgatcttgagcagaaaagttttaaatcagagtatggtgagatagatgaagaggaggaacaacctgagatgaagaggatgaaaagagaaggtgaagatgaagggatgtctatagaagtaagcaaaggagttaaagagccaagagttgtggttcagacaataagtgatattgatgttcttatagatggctttagatggaggaaatatggtcaaaaagttgtcaaaggaaatactaatccaaggagctactacaagtgcacattccaaggttgtggagtgaagaagcaagtggaaagatccgcagcagacgagagagcagttctcactacctatgaaggaagacacaatcacgatatcccaaccgcgctacgtcgctcgtgaaattattgggacttagtcactagtaatatgatttaggctttctaaaaacaaaaaatcttactatggcttatcttttgtgctcattcacagtttgtttatttgtttgttacacagtcaatactttgttttgtaaaaaaaaaaaaaaa

SEQ ID NO: 223 - protein, 393 aa, Arabidopsis thaliana
  G177 Amino Acid Sequence
MSSTSFTDLLGSSGVDCYEDDEDLRVSGSSFGGYYPERTGSGLPKFKTAQPPPLPISQSSHNFTFSDYLDSPLLLSSSHSLISPTTGTFPLQGFNGTTNNHSDFPWQLQSQPSNASSALQETYGVQDHEKKQEMIPNEIATQNNNQSFGTERQIKIPAYMVSRNSNDGYGWRKYGQKQVKKSENPRSYFKCTYPDCVSKKIVETASDGQITEIIYKGGHNHPKPEFTKRPSQSSLPSSVNGRRLFNPASVVSEPHDQSENSSISFDYSDLEQKSFKSEYGEIDEEEEQPEMKRMKREGEDEGMSIEVSKGVKEPRVVVQTISDIDVLIDGFRWRKYGQKVVKGNTNPRSYYKCTFQGCGVKKQVERSAADERAVLTTYEGRHNHDIPTALRRS

SEQ ID NO: 224 - DNA, 1537 bp, Arabidopsis thaliana
  G177 Genomic Sequence
atgtcttccacttctttcaccgaccttcttggttcttccggcgttgactgttacgaagatgatgaagacttgagagtttctgggtcgagttttggtgggtactatccagagagaaccgggtctggtttacctaagttcaagacggctcaaccaccacctcttccgatttcacaatcttctcataacttcactttctccgattaccttgattctcctctgcttctcagctcctcacacgtaataaagcttccattttttcttaattttcttctatttattgcagaaatgaaaaaaaaaaagacaatcttttgatctctggcttgtgttttgtcttgtttacttgcagagtttgatatctccaacaacaggaacgtttccattgcaaggctttaatggaacaacaaacaatcactcagattttccctggcagctacaatctcaaccatcaaacgcttcttctgtatgtgtttccttattagcgttttgaaacatcttcacttgctttgtattgatgaatcaaacttagtttcgttttttgttattttccaggctttgcaagaaacatatggtgttcaagatcacgagaagaagcaggagatgattcctaatgagattgcaacacaaaacaacaatcaaagttttggaacagaacgtcagataaagataccagcatacatggtgagtaggaactctaatgatggttatggttggagaaaatacggtcagaaacaagtgaagaagagcgaaaaccctaggagttacttcaagtgtacgtatcctgattgtgtttccaagaagattgttgagacggcttctgatggacagatcactgagatcatttataaaggtggtcataatcatcctaagcctgagttcaccaagagaccatctcaatcttcattaccatcatcggttaatgggaggcgcttgtttaatcctgcttctgttgttagtgaacctcatgatcaatcagagaactcttcgatttcgtttgactatagtgatcttgagcagaaaagttttaaatcagagtatggtgagatagatgaagaggaggaacaacctgagatgaagaggatgtaagtagttttttttaattagtggaagcaaaaggtttcttcttgggttttggaaatgacatgttttgagttttgtgtaacaggaaaagagaaggtgaagatgaagggatgtctatagaagtaagcaaaggagttaaagagccaagagttgtggttcagacaataagtgatattgatgttcttatagatggctttagatggaggaaatatggtcaaaaagttgtcaaaggaaatactaatccaaggttgtttatacaaaacttagtttctcaaattgttaacatgtttcaagtttctaatcctctctttgttgtaacaggagctactacaagtgcacattccaaggttgtggagtgaagaagcaagtggaaagatccgcagcagacgagagagcagttctcactacctatgaaggaagacacaatcacgatatcccaaccgcgctacgtcgctcgtga

SEQ ID NO: 225 - DNA, 1537 bp, Arabidopsis thaliana
  G177 DNA sequence used for BLAST
tcacgagcgacgtagcgcggttgggatatcgtgattgtgtcttccttcataggtagtgagaactgctctctcgtctgctgcggatctttccacttgcttcttcactccacaaccttggaatgtgcacttgtagtagctcctgttacaacaaagagaggattagaaacttgaaacatgttaacaatttgagaaactaagttttgtataaacaaccttggattagtatttcctttgacaactttttgaccatatttcctccatctaaagccatctataagaacatcaatatcacttattgtctgaaccacaactcttggctctttaactcctttgcttacttctatagacatcccttcatcttcaccttctcttttcctgttacacaaaactcaaaacatgtcatttccaaaacccaagaagaaaccttttgcttccactaattaaaaaaaactacttacatcctcttcatctcaggttgttcctcctcttcatctatctcaccatactctgatttaaaacttttctgctcaagatcactatagtcaaacgaaatcgaagagttctctgattgatcatgaggttcactaacaacagaagcaggattaaacaagcgcctcccattaaccgatgatggtaatgaagattgagatggtctcttggtgaactcaggcttaggatgattatgaccacctttataaatgatctcagtgatctgtccatcagaagccgtctcaacaatcttcttggaaacacaatcaggatacgtacacttgaagtaactcctagggttttcgctcttcttcacttgtttctgaccgtattttctccaaccataaccatcattagagttcctactcaccatgtatgctggtatctttatctgacgttctgttccaaaactttgattgttgttttgtgttgcaatctcattaggaatcatctcctgcttcttctcgtgatcttgaacaccatatgtttcttgcaaagcctggaaaataacaaaaaacgaaactaagtttgattcatcaatacaaagcaagtgaagatgtttcaaaacgctaataaggaaacacatacagaagaagcgtttgatggttgagattgtagctgccagggaaaatctgagtgattgtttgttgttccattaaagccttgcaatggaaacgttcctgttgttggagatatcaaactctgcaagtaaacaagacaaaacacaagccagagatcaaaagattgtctttttttttttcatttctgcaataaatagaagaaaattaagaaaaaatggaagctttattacgtgtgaggagctgagaagcagaggagaatcaaggtaatcggagaaagtgaagttatgagaagattgtgaaatcggaagaggtggtggttgagccgtcttgaacttaggtaaaccagacccggttctctctggatagtacccaccaaaactcgacccagaaactctcaagtcttcatcatcttcgtaacagtcaacgccggaagaaccaagaaggtcggtgaaagaagtggaagacat

SEQ ID NO: 226 - DNA, 1657 bp, Arabidopsis thaliana
  misc_feature (7)..(7): n is a, c, g, or t
  misc_feature (9)..(9): n is a, c, g, or t
  G178 cDNA Sequence
gttttcntncggagatcagtcggtcggaaagcggctacctttttgtctgcctagagaatttgttcgtttctttcttttactctcttcagacaaaacccacgagatacagaaaaagaggacaagagagaatcgtccatggaagaagacactggtatcgacgaagctaagacatacacggtggagaagagcgagaaagtggagccggagaaggacggactgagtcaattcagagacgaggaaaaatcacttggtgcggatatggaagatttacatgatgagactgtgcgagaaaccctaggcaaggatcaggttcaaggtgttcgagaaaattcctctgtggaaccaaatgttgaagatgtattagaagtgaatgagactgatagcgtcaaggaaactgttgtaagtgcgattgtgccggttgatgaagtggaagagaatcgtcaggtagaaacatctccttctctggctgcatcgtcagactcattgacagtgacgccatgtctatctttggatcctgcaactgcttcaaccgcacaagatttaccactggtttcagttccaactaaacaagagcaaagatcagattcgccggtggttaacagattgtcggttactcctgttcctaggacaccggctcgtgatggttataattggagaaaatatggacagaagcaggttaagagtcccaagggctcacggagttactacaggtgtacatacactgaatgttgtgctaaaaaaattgaatgctccaatgattcaggcaatgtggtagagattgttaacaaaggtttacatactcatgaacctccccggaagactagcttctccccgagagagattagagttacaacagctatccggcctgtttcagaggatgatacagtagtagaagagctatcaattgttcctagcggttcagatccgtctgcttctactaaagaatacatctgtgagtcgcaaacactcgttgaccggaaaagacactgtgagaacgaagctgtggaggaaccagagccaaaacgaagactgaaaaaagataactcacagagttcagattctgtctccaaacctggaaagaaaaacaaattcgtagtacacgcagctggtgatgttggtatctgtggtgatggatacaggtggcgtaaatacgggcagaaaatggtgaaaggaaatcctcatccaaggaactactaccgatgcacttcagcgggatgtccagttcgtaaacacattgagacagcagtcgagaacacaaaagcagtaataatcacatacaaaggagtacacaaccacgacatgccggtgcctaagaaacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctgattatatgtagtttatgagttttatagagttcatcgactcaattttcgcctccttgttcttgttatataataataataaaaaaccccatgaagattaccaactaaaaaaaaaaaaaaaaaaa

SEQ ID NO: 227 - protein, 466 aa, Arabidopsis thaliana
  G178 Amino Acid Sequence
MEEDTGIDEAKTYTVEKSEKVEPEKDGLSQFRDEEKSLGADMEDLHDETVRETLGKDQVQGVRENSSVEPNVEDVLEVNETDSVKETVVSAIVPVDEVEENRQVETSPSLAASSDSLTVTPCLSLDPATASTAQDLPLVSVPTKQEQRSDSPVVNRLSVTPVPRTPARDGYNWRKYGQKQVKSPKGSRSYYRCTYTECCAKKIECSNDSGNVVEIVNKGLHTHEPPRKTSFSPREIRVTTAIRPVSEDDTVVEELSIVPSGSDPSASTKEYICESQTLVDRKRHCENEAVEEPEPKRRLKKDNSQSSDSVSKPGKKNKFVVHAAGDVGICGDGYRWRKYGQKMVKGNPHPRNYYRCTSAGCPVRKHIETAVENTKAVIITYKGVHNHDMPVPKKRHGPPSSMLVAAAAPTSMRTRTDDQVNIPTSSQCSVGRESEKQSKEALDVGGEKVMESARTLLSIGFEIKQC

SEQ ID NO: 228 - DNA, 1993 bp, Arabidopsis thaliana
  G178 Genomic Sequence
atggaagaagacactggtatcgacgaagctaagacatacacggtggagaagagcgagaaagtggagccggagaaggacggactgagtcaattcagagacgaggaaaaatcacttggtgcggatatggaagatttacatgatgagactgtgcgagaaaccctaggcaaggatcaggttcaaggtaacggtttattctgcgcaaaattctttattggtttttatttatttattcgagactttattttttgacgaaatgatgtttgagtttaccaggtgttcgagaaaattcctctgtggaaccaaatgttgaagatgtattagaagtgaatgtgagtttgcttcagactcttctgctattcataaactttcttaacacttacaactttgattctctcattaacattgattgtgctagaacttgtaaagtttaactcatttcagtgtcttcgatgttactcgttcagtgattatacaataacatgggaataggattaatcgtaatggttttaacctttggccaagttcaatctgtatctgtatcagtttgatctgttacattttagtgtgtctgatttcttaggcaattctgaggacaagaatcactgttatcaaggcatgacatttaactgctttttgtatcacattggcaggagactgatagcgtcaaggaaactgttgtaagtgcgattgtgccggttgatgaagtggaagagaatcgtcaggtagaaacatctccttctctggctgcatcgtcagactcattgacagtgacgccatgtctatctttggatcctgcaactgcttcaaccgcacaagatttaccactggtttcagttccaactaaacaagagcaaagatcagattcgccggtggttaacagattgtcggttactcctgttcctaggacaccggctcgtgatggttataattggagaaaatatggacagaagcaggttaagagtcccaagggctcacggagttactacaggtgtacatacactgaatgttgtgctaaaaaaattgaatgctccaatgattcaggcaatgtggtagagattgttaacaaaggtttacatactcatgaacctccccggaagactagcttctccccgagagagattagagttacaacagctatccggcctgtttcagaggatgatacagtagtagaagagctatcaattgttcctagcggttcagatccgtctgcttctactaaagaatacatctgtgagtcgcaaacactcgttgaccggaaaagacactgtgagaacgaagctgtggaggaaccagagccaaaacgaaggcaagtttgtagaattttgcatttcggtgcttactcttcactttgaaagatgaaattaatagactttcttctctctatttttcagactgaaaaaagataactcacagagttcagattctgtctccaaacctggaaagaaaaacaaattcgtagtacacgcagctggtgatgttggtatctgtggtgatggatacaggtggcgtaaatacgggcagaaaatggtgaaaggaaatcctcatccaaggtctagaaaactaaacgcatgacccatctctttatccacatatgacatcttctaatacgcatggtgattgatttgttctgtttcaaacattcaggaactactaccgatgcacttcagcgggatgtccagttcgtaaacacattgagacagcagtcgagaacacaaaagcagtaataatcacatacaaaggagtacacaaccacgacatgccggtgcctaagaaacgccatggtcctccaagctcaatgctcgtagctgcagccgctccaacatcaatgagaaccaggacagacgatcaggtgaacattccgacttcaagccagtgctcggtggggcgagaaagtgagaagcagagtaaagaagcattggacgttggtggagagaaagtgatggaatcagctaggactttgttgagcattggattcgaaatcaagcaatgctga

SEQ ID NO: 229 - DNA, 1993 bp, Arabidopsis thaliana; identical to SEQ ID NO: 228
  G178 DNA sequence used for BLAST

SEQ ID NO: 230 - DNA, 837 bp, Arabidopsis thaliana; identical to SEQ ID NO: 100
  G180 cDNA Sequence

SEQ ID NO: 231 - protein, 191 aa, Arabidopsis thaliana
  G180 Amino Acid Sequence
MNFLVPFEETNVLTFFSSSSSSSLSSPSFPIHNSSSTTTTHAPLGFSNNLQGGGPLGSKVVNDDQENFGGGTNNDAHSNSWWRSNSGSGDMKNKVKIRRKLREPRFCFQTKSDVDVLDDGYKWRKYGQKVVKNSLHPRSYYRCTHNNCRVKKRVERLSEDCRMVITTYEGRHNHIPSDDSTSPDHDCLSSF

SEQ ID NO: 232 - DNA, 1609 bp, Arabidopsis thaliana
  G180 Genomic Sequence
atgaacttcctcgttccttttgaagaaaccaatgtcttaacctttttctcttcttcttcttcctcttctctttcttctccttctttccccattcacaactcttcctccactactactactcatgcacctctagggttttctaataatcttcaggtctttgatctctctttctttatatacatatataaaaagatcttgtttaattttatttgaagtatttattgatcttgatttggaaggtctaatatgattttttgtagggtggaggacccttgggatcaaaggtggttaatgatgatcaggagaattttggaggtggaactaacaatgatgctcattctaattcttggtaatttacatcgttggattaaaagatgaatccatttcttcttcttgttcatgttaatttattctctttttttcttcttcaataactgattaattaattaaacttttatatctcccttgcattttttttgtgatccaatagaactatagactatatatttacactaagacttatgagaaaggattaaacctaaggtataaagtataaacaatgtgtctaagacattagagtgtactcaggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggtactaaattagttaattatcatcaccaccacatatatgtgactgcttaggcttcattaactttaccaatagtttcctaatataacatgtccttaattagcagtgatcctcgtataatcacattggttgatgattgatagtttcgtaaaagctgaggtgaaaacttaatttagctaggtgcatcataatattctctctttaggctcttatggaaccgtagctcaagtactagacatgactactgtttatcttatacatatgtatattcatagttagaattatatttattgtacgtactaacgtacatatagttttagtatgtatcgtctgtacgtccctcgggtgctgtcatcattaagaatgcaaaaaatatccctttctatttttatctctttttattgtgccatgtctacacatatattcccaactatttttgaacatattcacacgtttttaatggttaattgaatttaattattatgtctaatgatgtgtattaatgaatgaaacatataaacaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattga

SEQ ID NO: 233 - DNA, 1609 bp, Arabidopsis thaliana
  G180 DNA sequence used for BLAST
tcaatatatattattacatatgtatactataagcaacaagtcaagaatatatgcataacatctgatgacatactcttgaaaaacacatgcaatatcaaatatgcaatatatcacacatctatatgtgcacatataactgtctatatatagatatatagaaagagatgttaaaaggaagagagacaatcatggtcaggagaagtggagtcatcagagggaatgtggttgtgacgaccttcgtaagtagtaatcaccattctacaatcttccgatagtcgctccactctctttttcaccctacagttgttgtgtgtgcatctgtaataactcctgtttatatgtttcattcattaatacacatcattagacataataattaaattcaattaaccattaaaaacgtgtgaatatgttcaaaaatagttgggaatatatgtgtagacatggcacaataaaaagagataaaaatagaaagggatattttttgcattcttaatgatgacagcacccgagggacgtacagacgatacatactaaaactatatgtacgttagtacgtacaataaatataattctaactatgaatatacatatgtataagataaacagtagtcatgtctagtacttgagctacggttccataagagcctaaagagagaatattatgatgcacctagctaaattaagttttcacctcagcttttacgaaactatcaatcatcaaccaatgtgattatacgaggatcactgctaattaaggacatgttatattaggaaactattggtaaagttaatgaagcctaagcagtcacatatatgtggtggtgatgataattaactaatttagtacctggggtgaaggctgttcttgacgactttctgaccatatttacgccatttgtagccatcgtcaagaacatcaacatcgcttttggtttggaaacagaatcttggctctcttagtttcctccttatcttcactttgttcttcatatctccacttccactatttgatctccacctgagtacactctaatgtcttagacacattgtttatactttataccttaggtttaatcctttctcataagtcttagtgtaaatatatagtctatagttctattggatcacaaaaaaaatgcaagggagatataaaagtttaattaattaatcagttattgaagaagaaaaaaagagaataaattaacatgaacaagaagaagaaatggattcatcttttaatccaacgatgtaaattaccaagaattagaatgagcatcattgttagttccacctccaaaattctcctgatcatcattaaccacctttgatcccaagggtcctccaccctacaaaaaatcatattagaccttccaaatcaagatcaataaatacttcaaataaaattaaacaagatctttttatatatgtatataaagaaagagagatcaaagacctgaagattattagaaaaccctagaggtgcatgagtagtagtagtggaggaagagttgtgaatggggaaagaaggagaagaaagagaagaggaagaagaagaagagaaaaaggttaagacattggtttcttcaaaaggaacgaggaagttcat

SEQ ID NO: 234 - DNA, 1136 bp, Arabidopsis thaliana; identical to SEQ ID NO: 56
  G187 cDNA Sequence

SEQ ID NO: 235 - protein, 318 aa, Arabidopsis thaliana
  G187 Amino Acid Sequence
MSNETRDLYNYQYPSSFSLHEMMNLPTSNPSSYGNLPSQNGFNPSTYSFTDCLQSSPAAYESLLQKTFGLSPSSSEVFNSSIDQEPNRDVTNDVINGGACNETETRVSPSNSSSSEADHPGEDSGKSRRKRELVGEEDQISKKVGKTKKTEVKKQREPRVSFMTKSEVDHLEDGYRWRKYGQKAVKNSPYPRSYYRCTTQKCNVKKRVERSFQDPTVVITTYEGQHNHPIPTNLRGSSAAAAMFSADLMTPRSFAHDMFRTAAYTNGGSVAAALDYGYGQSGYGSVNSNPSSHQVYHQGGEYELLREIFPSIFFKQEP

SEQ ID NO: 236 - DNA, 1184 bp, Arabidopsis thaliana
  G187 Genomic Sequence
atgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagtgtaagtcataactctataggaacttttatgcaaaacattgaacatcatttgatctcttcgtttaggaatttagtctagcatgtgtattaattttatagtgtattatttttcagtgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggtaactaaactttccctttttattttttgaaattgctaggcttgtgaaaatttgtgtttagaaaaatgcgaccattatagtgtaactgataatagccaatggaaacgaaaataggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttga

SEQ ID NO: 237 - DNA, 1184 bp, Arabidopsis thaliana; identical to SEQ ID NO: 236
  G187 DNA sequence used for BLAST

SEQ ID NO: 238 - DNA, 1223 bp, Arabidopsis thaliana
  misc_feature (1196)..(1199): n is a, c, g, or t
  G188 cDNA Sequence
ctctcaccaacataatcaaagaagctttcctcacgaattcaagatcgccatgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatgatgaaaacgaataaaatctcaatttacaatttacaaaaagaaaaaagtcagtttttaattattatttttgtttgttaaaacttgacatttattgtgttatnnnncaataaaaaaaaaaaaaaaaaaaa

SEQ ID NO: 239 - protein, 348 aa, Arabidopsis thaliana
  G188 Amino Acid Sequence
MSSEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 240 - DNA, 1223 bp, Arabidopsis thaliana
  G188 Genomic Sequence
atgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaaggtttgttcatatcgaactaaacacatctcttagttcaaagtttctttctttaattatcttttttgtcttgttgcttgtagaaagaatcagcaaaaaagaaccatatgtcatgtaacgcaagagaatctttcttctgatttgtgggcttggcgtaaatacggtcaaaaacccatcaaaggctctccttatccaaggttatcatcaatctttttttcaaaattttctcaagaaaaaaatattaacatttttttaattaatgtgttaattaatcgagttattacataaaacaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatga

SEQ ID NO: 241 - DNA, 1223 bp, Arabidopsis thaliana; identical to SEQ ID NO: 240
  G188 DNA sequence used for BLAST

SEQ ID NO: 242 - DNA, 1034 bp, Arabidopsis thaliana
  G190 cDNA Sequence
gaaaaagaaaacaaacaagaaacacatacacacacacacaagttcactatactctatggaaatgaactccccacacgaaaaggcggtgcaagctatccgttatggccatagctgcgccatgcggttgaagaggcggctcaaccatccaatggctgatggtggaccgctttcaagttatgatcttgctaaatcgatcgttgaaagtttttccaatgccatttcaatcttatctgctaaaccagaaaccgaagatgatcagttttctgatttatcttctagggattcttctcctcctccacaggggagcccctccaagaaaagaaagattgatagtacaaattcaagtgagaattggagggacgattcaccggatccgatttactacgacgggtatctttggaggaaatatggtcaaaagagtataaaaaaatctaatcaccaaaggagttactatagatgttcttacaacaaagatcataactgcgaagcaagaaagcatgaacaaaagatcaaagacaatcctccggtttaccgaaccacttactttggccaccacacttgcaaaaccgaacataatctagatgccatttttattgccggacaagatcccctagatgactttaaaagtacccaaatgatccgattcggaaaagatcaggatcaggagaaggaaagccgctcgaacggtttctccttatcggttaagcatgaagaagatatcatcaaagagcaagctatagatcagtaccgtgagataaccagtaatgaccaagattgtcaagatgttatagaagaatatctatcatcaccatcaggctcttatcctccttcatcgtcatctggcagtgaaagtgctgactttaattctgatttgttatttgacaacccagactcgtgggatcgttatgatcagttttacttttgattgcactagatttttcagctaaaactatttaataatgttttcctttttatgagattgtatatatttgagaattgtgactatttaagtatttatgttattgattagataa

SEQ ID NO: 243 - protein, 289 aa, Arabidopsis thaliana
  G190 Amino Acid Sequence
MEMNSPHEKAVQAIRYGHSCAMRLKRRLNHPMADGGPLSSYDLAKSIVESFSNAISILSAKPETEDDQFSDLSSRDSSPPPQGSPSKKRKIDSTNSSENWRDDSPDPIYYDGYLWRKYGQKSIKKSNHQRSYYRCSYNKDHNCEARKHEQKIKDNPPVYRTTYFGHHTCKTEHNLDAIFIAGQDPLDDFKSTQMIRFGKDQDQEKESRSNGFSLSVKHEEDIIKEQAIDQYREITSNDQDCQDVIEEYLSSPSGSYPPSSSSGSESADFNSDLLFDNPDSWDRYDQFYF

SEQ ID NO: 244 - DNA, 1100 bp, Arabidopsis thaliana
  G190 Genomic Sequence
atggaaatgaactccccacacgaaaaggcggtgcaagctatccgttatggccatagctgcgccatgcggttgaagaggcggctcaaccatccaatggctgatggtggaccgctttcaagttatgatcttgctaaatcgatcgttgaaagtttttccaatgccatttcaatcttatctgctaaaccagaaaccgaagatgatcagttttctgatttatcttctagggattcttctcctcctccacaggggagcccctccaagaaaaggtatacacttatgagtttgttttcttttttgagtttgtttttgtttttccaaatgaaaccacaattcttaatataagtattttttttcttaggagtatatgttgattttaatgctaatattttgataatactcatgtttgcagaaagattgatagtacaaattcaagtgagaattggagggacgattcaccggatccgatttactacgacgggtatctttggaggaaatatggtcaaaagagtataaaaaaatctaatcaccaaaggtaagaaatagtatagctaatcatatttcatcataattatttctatcccgatcactcatactaattggtgtatgatgatggtaacaggagttactatagatgttcttacaacaaagatcataactgcgaagcaagaaagcatgaacaaaagatcaaagacaatcctccggtttaccgaaccacttactttggccaccacacttgcaaaaccgaacataatctagatgccatttttattgccggacaagatcccctagatgactttaaaagtacccaaatgatccgattcggaaaagatcaggatcaggagaaggaaagccgctcgaacggtttctccttatcggttaagcatgaagaagatatcatcaaagagcaagctatagatcagtaccgtgagataaccagtaatgaccaagattgtcaagatgttatagaagaatatctatcatcaccatcaggctcttatcctccttcatcgtcatctggcagtgaaagtgctgactttaattctgatttgttatttgacaacccagactcgtgggatcgttatgatcagttttacttttga

SEQ ID NO: 245 - DNA, 1100 bp, Arabidopsis thaliana
  G190 DNA sequence used for BLAST
tcaaaagtaaaactgatcataacgatcccacgagtctgggttgtcaaataacaaatcagaattaaagtcagcactttcactgccagatgacgatgaaggaggataagagcctgatggtgatgatagatattcttctataacatcttgacaatcttggtcattactggttatctcacggtactgatctatagcttgctctttgatgatatcttcttcatgcttaaccgataaggagaaaccgttcgagcggctttccttctcctgatcctgatcttttccgaatcggatcatttgggtacttttaaagtcatctaggggatcttgtccggcaataaaaatggcatctagattatgttcggttttgcaagtgtggtggccaaagtaagtggttcggtaaaccggaggattgtctttgatcttttgttcatgctttcttgcttcgcagttatgatctttgttgtaagaacatctatagtaactcctgttaccatcatcatacaccaattagtatgagtgatcgggatagaaataattatgatgaaatatgattagctatactatttcttacctttggtgattagatttttttatactcttttgaccatatttcctccaaagatacccgtcgtagtaaatcggatccggtgaatcgtccctccaattctcacttgaatttgtactatcaatctttctgcaaacatgagtattatcaaaatattagcattaaaatcaacatatactcctaagaaaaaaaatacttatattaagaattgtggtttcatttggaaaaacaaaaacaaactcaaaaaagaaaacaaactcataagtgtataccttttcttggaggggctcccctgtggaggaggagaagaatccctagaagataaatcagaaaactgatcatcttcggtttctggtttagcagataagattgaaatggcattggaaaaactttcaacgatcgatttagcaagatcataacttgaaagcggtccaccatcagccattggatggttgagccgcctcttcaaccgcatggcgcagctatggccataacggatagcttgcaccgccttttcgtgtggggagttcatttccat

SEQ ID NO: 246 - DNA, 1171 bp, Arabidopsis thaliana; identical to SEQ ID NO: 91
  G192 cDNA Sequence

SEQ ID NO: 247 - protein, 298 aa, Arabidopsis thaliana
  G192 Amino Acid Sequence
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 248 - DNA, 1291 bp, Arabidopsis thaliana
  G192 Genomic Sequence
atggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaaggttcgtttcttcacccaattttcgataaagtttaaaccttttgtcaaacccatcaacaagtttacgaaattctgttgaattaatcaaaattccgaattttgctgtatagaaatggttaaaagtctcaatttttgtcgaacccatcaaatttgattgaatcaagaaggctaaaataaaaagtctctgtttttatttggttgcttgttacagaaagatacagcataagaaagtgtgccatgtagcagcagaagctttaaactccgatgtctgggcatggcgaaagtacggacagaaacccatcaaaggttcaccatatccaaggtaaaaccaaaaaaattaccagaaaaaaaaaagtcatttattgagttataaatgtgtgtattctttcaagacaaaagaaacttgtctgtttttgtgattctgtctgattttggtttgttaaattattatctgcgttacatttttggtaaaggattctaattaattctcattttcatgaaaacagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatga

SEQ ID NO: 249 - DNA, 1291 bp, Arabidopsis thaliana; identical to SEQ ID NO: 248
  G192 DNA sequence used for BLAST

SEQ ID NO: 250 - DNA, 1418 bp, Arabidopsis thaliana
  G194 cDNA Sequence
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 251 - protein, 337 aa, Arabidopsis thaliana
  G194 Amino Acid Sequence
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 252 - DNA, 1402 bp, Arabidopsis thaliana
  G194 Genomic Sequence
atggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagtgagttcttaaaatttctcacttttttttttgttgagtccagaagctgttcgataaaaagtctcagagacaaaaaaaaaaagaagtatcctaaagaaagcatttttaatgaacaggttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggtatcagcaaatatatccatatcctttgaccatagttttacaacaacaagaagaaaaatcaaatctttttccttgttgttttgtttcttcttttttgatttgctcttgggtacatgcactatgttaatttgttggatctagcactgtcccattgtttcttaatgtttgggtgttagtgtttactaattaaatttactactgtttacagtgtccaaagaaagacttaattgtgaaccaaagttgattttgtgtaaatggtgtttcgtttgcaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtag

SEQ ID NO: 253 - DNA, 1402 bp, Arabidopsis thaliana
  G194 DNA sequence used for BLAST
ctactcttccttcaacatatgagacggaacaacatcttgcagaagtccattatctttaaccaaaactcgactcttcttcacacgattatcatcaccatactcattagcgtggctattaaggtactcgttgactcctccaaaacaagacatgagttcttgttgctgctgttggtgatggtattggacaagctgttggaactgaggagagattaacgtggagccatcaataggaaacccaaagcaaccattaccgagactcgaagcagctcctgacgatccgaagaaacctccagtggaaataggacgagacgtgagtggactaatgtgagtgtgttgaccttcgtaggttgtaaccacagtgcttggatctctgaatgatctctccactctcttcttcacgttacatgaagccgttgtgcaacggtagtaactcctgcaaacgaaacaccatttacacaaaatcaactttggttcacaattaagtctttctttggacactgtaaacagtagtaaatttaattagtaaacactaacacccaaacattaagaaacaatgggacagtgctagatccaacaaattaacatagtgcatgtacccaagagcaaatcaaaaaagaagaaacaaaacaacaaggaaaaagatttgatttttcttcttgttgttgtaaaactatggtcaaaggatatggatatatttgctgatacctgggaaaaggactgtttttgacagctttttgaccatattttcgccagcgataaccatcttcgagatgatcaacttcactctttgtcatgaatgcgactcttgcctctctctgtctcttctgattattcttctttgctttcaacctgttcattaaaaatgctttctttaggatacttctttttttttttgtctctgagactttttatcgaacagcttctggactcaacaaaaaaaaaagtgagaaattttaagaactcactgtttcttagtatgactcttctcttgttgatcttcacctccttcttcttcattgtcttctgttttcggtttctcttcatttagagcctcgcttgaagcagacgaaatcgatgacgagttaggagtcgccggtgggtttatcaacaaatgatccgaacacaaagactccacctttgacgtcactaattgctctgacggtggagcttgaatgatacttgaagacagcttcgccgatggttgcgtttgcgtttgcggttgagacgtttggagaaggaaggaatgaggagaaacagtagcaaagtcttgatgctgctgagaacttaataactccatgaaccctaaagaatgcctctccgccgccgctaaatctccgaaatcccaaacgctttgtgacgacgggtagtaaaaactcgtctttgagaaatctgtaaactccat

SEQ ID NO: 254 - DNA, 825 bp, Arabidopsis thaliana
  G197 cDNA Sequence
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 255 - protein, 274 aa, Arabidopsis thaliana
  G197 Amino Acid Sequence
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 256 - DNA, 920 bp, Arabidopsis thaliana
  G197 Genomic Sequence
tcatttcatttccaaagtgctaaaatccaaaaccctagtgttgtttagacccaagaagtcataaccaatgctactactaatgtcggttgaagaataactgctgctactactgtcctctgtttgacatttcacattattacagctacactccttgccgttcccgaatccaaaacggcacgcactgcacctatacttcactctcccaaaccttaggttcctctcatcatggagcttgtcttgccatggtggactgatcctaagctcaagattcaagtccagacatctttcttcaacaactgagtactcaactctcttttgaattctctcgtccccgaaatttgctattttctccagctgaggaccaaaagagagaatcttgacaagagggtcctctgttttactagaatcagacgaatcttgagaagttttggtctcgttgataggtcgatgagtcgccggatcaatcccttttcttaatagcttcctcttaacatgtgtgttccagtaattcttaatctcgttatctgttcttcctggtaatctcgtcgcaataagagaccacctgatagaagaaaaaaaaaacagagtttaaaaaacagagctttttaacataacagaggatagtaaaaaaaacagaggagttgttttgtgactcacttgttaccgagaaggctatgtagtttgatgatgagatcatcttcttcgagggtgaagttacccctcttgagatcaggtcggagatagttaatccatcggagacgacagctttttccgcaacgttgaagaccggcggatctaggaagagaacgccaacaaccttcaccgtgagctttgatgtaagagatgagcttatcgtcttcttccttagtccaagctcctttgtttgtgtggtctttctcacagcaaggagaccttcccat

SEQ ID NO: 257 - DNA, 920 bp, Arabidopsis thaliana; identical to SEQ ID NO: 256
  G197 DNA sequence used for BLAST

SEQ ID NO: 258 - DNA, 1089 bp, Arabidopsis thaliana
  G198 cDNA Sequence
atggcaaggtcaccttgttgcgagaagaacggactcaagaaagggccatggacatctgaagaagaccagaagcttgttgactatatccagaaacatggttatggtaactggagaaccctccccaaaaatgccggtacgtgtttgcaaagatgtggcaaaagttgtaggttaaggtggactaattatctccgaccagatataaaacgaggaagattctcttttgaggaagaagaagccattattcagcttcatagcttcttaggaaacaagtggtctgcgattgcggcgcgtttgccaggaagaacagataatgagatcaagaacttttggaacactcatataagaaagaagctacttagaatggggattgatccagtgactcacagtccacgactcgatctcctcgatatctcatccatcttagcttcatctctatacaattcatcttcacatcacatgaacatgtcaagactcatgatggatactaatcgtcgtcatcagcaacaacatccattggttaaccccgagatactcaagcttgcgacctctatattctctcaaaaccaaaaccaaaaccacaaccaaaatcaaaaccaaaaccaaaacctcgtggtggatcatgagaagcaaacagtttatcatcatcatgatgttaaccaaaccggagtaaaccaataccaaaccgaccaatatttcgagaacgcgattactcaagaactccaatcttccatgccaccattccccaatgaagctcatcagtttaacgacatggatcatcacttcaatggttttggagaacaaaatcttgtttcaacttctactacgtcagtccaagattgctataatccgtcattcaacgattattcaagttcaaattttgtcttagatcattcttattcggatcagagcttcaacttcgcaaattcggtcttaaacacgccatcctcgagcccgagcccgactacgttaaactcgagttacatcaatagtagcagttgcagcactgaggatgaaatagaaagctattgcagtaatctcatgaagtttgatattcccgatttcttggacgttaatggttttattatataa

SEQ ID NO: 259 - protein, 362 aa, Arabidopsis thaliana
  G198 Amino Acid Sequence
MARSPCCEKNGLKKGPWTSEEDQKLVDYIQKHGYGNWRTLPKNAGTCLQRCGKSCRLRWTNYLRPDIKRGRFSFEEEEAIIQLHSFLGNKWSAIAARLPGRTDNEIKNFWNTHIRKKLLRMGIDPVTHSPRLDLLDISSILASSLYNSSSHHMNMSRLMMDTNRRHQQQHPLVNPEILKLATSIFSQNQNQNHNQNQNQNQNLVVDHEKQTVYHHHDVNQTGVNQYQTDQYFENAITQELQSSMPPFPNEAHQFNDMDHHFNGFGEQNLVSTSTTSVQDCYNPSFNDYSSSNFVLDHSYSDQSFNFANSVLNTPSSSPSPTTLNSSYINSSSCSTEDEIESYCSNLMKFDIPDFLDVNGFII

SEQ ID NO: 260 - DNA, 1228 bp, Arabidopsis thaliana
  G198 Genomic Sequence
ttatataataaaaccattaacgtccaagaaatcgggaatatcaaacttcatgagattactgcaatagctttctatttcatcctcagtgctgcaactgctactattgatgtaactcgagtttaacgtagtcgggctcgggctcgaggatggcgtgtttaagaccgaatttgcgaagttgaagctctgatccgaataagaaggatccaagacaaaatttgaacttgaataatcgttgaatgacggattatagcaatcttggactgacgtagtagaagttgaaacaagattttgttctccaaaaccattgaagtgatgatccatgttgttaaactgacgagcttcattggggaatggtggcatggaagattggagttcttgagtaatcgtgttctcgaaatattggttggtttggtattggtttactccggtttggctataaactgtttgcttctcttgagttctcgagtcatgatccaccacaaggttttggttttgattttgagagaagagagaggtagcgagcttgagtatctcggggttaaccaatggatgttgctggtgatgacgacgattagtatccatcatgagtcttgacatgttcatgtgatgtgaagatgaattgtatagagatgaagctaagatggatgagatatcgaggagatcgagtcgtggactgtgagtcactggatcaatccccattctaagtagcttctttcttatatgagtgttccaaaagttcttgatctcattatctgttcttcctggtaaacgcgccgcaatcgcagaccacctataacaagataaaccaaacacgtaagaatcttgaactattttcatagtagatattgtcggaggagaaaaaaaaagcaaacttacttgtttcctaagaagctatgaagctgaataatggtttcttcttcctcaaaagagaaccttcctcgctttatatctggtcggagataattagtccaccttaacctacaacttttgccacatctttgcaaacctgatgaagagaaaaaaacatattacaatttgaaactttcgaaaaacataactaaaacatgaataataaatgaaaattaagacacgtaccggcatttttggggagggttctccagttaccataaccatgtttctggatatagtcaacaagcttctggtcttcttcagatgtccaaggccctttcttgagtccgttcttctcgcaacaaggtgaccttgccat

SEQ ID NO: 261 - DNA, 1228 bp, Arabidopsis thaliana; identical to SEQ ID NO: 260
  G198 DNA sequence used for BLAST

SEQ ID NO: 262 - DNA, 949 bp, Arabidopsis thaliana
  G200 cDNA Sequence
gagagagaaagatgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcacagaaaacatttcccgccttgtggagggttggatgagagcgtctccaaagagtagtacaagtactactttcttggaacacaaaatgcagaaccggacaaacaatttcatcgatcatcacagtgatcagtttccatacgagcagcttcaaggttctagggaagagggtcatagcaaaggaatcaacggggatgatgaccagggtataaagaattcagagaataacaacggtgatgatgttcatcatgaagatggtgatcatgaggatgatgatgatcataatgcaacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagac

SEQ ID NO: 263 - protein, 280 aa, Arabidopsis thaliana
  G200 Amino Acid Sequence
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLVEGWMRASPKSSTSTTFLEHKMQNRTNNFIDHHSDQFPYEQLQGSREEGHSKGINGDDDQGIKNSENNNGDDVHHEDGDHEDDDDHNATPPLTFIEKWLLEETSTTGGQMEEMSHLMELSNML

SEQ ID NO: 264 - DNA, 1051 bp, Arabidopsis thaliana
  G200 Genomic Sequence
ttaaagcatattagagagctccatcaagtggctcatctcttccatttgacccccagtagtacttgtttcctccaaaagccatttctcaataaatgtcaatggtggtgtagcattatgatcatcatcatcctcatgatcaccatcttcatgatgaacatcatcaccgttgttattctctgaattctttataccctggtcatcatccccgttgattcctttgctatgaccctcttcccaagaaccttgaagctgctcgtatggaaactgatcgctgtgatgatcgatgaaattgtttgtccggttctgcattttgtgttccaagaaagtagtacttgtactactctttggagacgctctcatccaaccctcaagaaggcgggaaatgttttcggtgcttgaagcataggtagatctatgattaatggtgtttcttgtcgaagaagtttgcagcgcaatgttctctgatctgctcctctcatcactgtcagacttgttgagcttcttctttaaatgtgtgttccagtagttcttgatatcattgtccgttctttgtggtaggtatgaagctatggacgcccatcttaccacaaccatatgtaaacaaataagccagtttagggttcacatcatcaaaatatatacacaaaacattcaagtataaagagatgtagatccttttgtctgagattacttgttacccaataaggcttgcaagtgaatgatcattccttcttcatgaggagtaaagtttccacgtttaattccaggtctcagataatttgtccatctcagtctacaacttttgctgcatctcaataacccttttaaaagccaaattaagatacaaacatcaggacacatatacaaacaaagaaaagaaagacactagaagaaaacatgttgagaaaagataatgaccagtgttggtgggaactgatctccagtttccaggaccatgttcttgaatgtaagaaacaagaatgatatcttcttcaggagtccatggtcctttcttgatccctatcttgtcacagcatggaggcctacccat

SEQ ID NO: 265 - DNA, 1051 bp, Arabidopsis thaliana; identical to SEQ ID NO: 264
  G200 DNA sequence used for BLAST

SEQ ID NO: 266 - DNA, 1292 bp, Arabidopsis thaliana
  G201 cDNA Sequence
atgtcaagaaagccatgttgtgtgggagaaggactgaagaaaggagcatggactgccgaagaagacaagaaactcatctcttacattcatgaacacggtggaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacaatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattatgacgacaagaacttcatatgatccgttgattgcttaccggactagagttgaccggttaatgtcatatggttctcttagatatttgtcaagttatagtaaaggtccactatagggtcactatatattaatattcagtaatggattctcttagttagagaaccttgtgatgccgtggatcaattagtatttgatttgcgggagacacgagttttttttccttctattgttgtttgtggatttacgtactataaataataaataaaacacccatttgattgcaaaaaaaaaaaaaaaaaaaaaaa

SEQ ID NO: 267 - protein, 336 aa, Arabidopsis thaliana
  G201 Amino Acid Sequence
MSRKPCCVGEGLKKGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKKLLIDKGIDPVTHKPLAYDSNPDEQSQSGSISPKSLPPSSSKNVPEITSSDETPKYDASLSSKKRCFKRSSSTSKLLNKVAARASSMGTILGASIEGTLISSTPLSSCLNDDFSETSQFQMEEFDPFYQSSEHIIDHMKEDISINNSEYNFSQFLEQFSNNEGEEADNTGGGYNQDLLMSDVSSTSVDEDEMMQNITGWSNYLLDHSDFNYDTSQDYDDKNFI

SEQ ID NO: 268 - DNA, 1196 bp, Arabidopsis thaliana
  G201 Genomic Sequence
atgtcaagaaagccatgttgtgtgggagaaggactgaagaaaggagcatggactgccgaagaagacaagaaactcatctcttacattcatgaacacggtgaaggaggctggcgtgacattccccaaaaagctggtatatatgtgctttattattatgtatatattttaaaacactttttacatatatataactataattgttgtttttatgacaaatgatggtgtttaggactaaaacgatgtggaaagagttgtagattgcgatgggctaactatttgaaacctgacatcaagagaggagagtttagctatgaggaggaacagattatcatcatgctacacgcttctcgcggcaacaagtaaaatcctagcttgccgaaatccatataaataagggtatatataattaacacattattaaagtttatatatatgttttacttaaaaggtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcatatga

SEQ ID NO: 269 - DNA, 1193 bp, Arabidopsis thaliana
  G201 DNA sequence used for BLAST
atgtcaagaaagccatgttgtgtgggagaaggactgaagaaaggagcatggactgccgaagaagacaagaaactcatctcttacattcatgaacacggtgaaggaggctggcgtgacattccccaaaaagctggtatatatgtgctttattattatgtatatattttaaaacactttttacatatatataactataattgttgtttttatgacaaatgatggtgtttaggactaaaacgatgtggaaagagttgtagattgcgatgggctaactatttgaaacctgacatcaagagaggagagtttagctatgaggaggaacagattatcatcatgctacacgcttctcgcggcaacaagtaaaatcctagcttgccgaaatccatataaataagggtatatataattaacacattattaaagtttatatatatgttttacttaaaaggtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcata

SEQ ID NO: 270 - DNA, 1101 bp, Arabidopsis thaliana
  G202 cDNA Sequence
atgtcaagaaagccatgttgcgtcggagaaggcttgaagaaaggagcatggaccaccgaggaggacaagaaactcatctcttacatccacgaccacggcgagggaggctggcgcgacattccccaaaaagctgggttgaaacggtgtggaaagagttgtagactgcgatggaccaactaccttaaacctgagatcaaaagaggcgagtttagttcagaggaagagcagattatcatcatgcttcatgcttctcgtggcaacaagtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatga

SEQ ID NO: 271 - protein, 366 aa, Arabidopsis thaliana
  G202 Amino Acid Sequence
MSRKPCCVGEGLKKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRLMEQGIDPVTHKPLASSSNPTVDENLNSPNASSSDKQYSRSSSMPFLSRPPPSSCNMVSKVSELSSNDGTPIQGSSLSCKKRFKKSSSTSRLLNKVAAKATSIKDILSASMEGSLSATTISHASFFNGFTEQIRNEEDSSNTSLTNTLAEFDPFSPSSLYPEHEINATSDLNMDQDYDFSQFFEKFGGDNHNEENSMNDLLMSDVSQEVSSTSVDDQDNMVGNFEGWSNYLLDHTNFMYDTDSDSLEKHFI

SEQ ID NO: 272 - DNA, 1321 bp, Arabidopsis thaliana
  G202 Genomic Sequence
atgtcaagaaagccatgttgcgtcggagaaggcttgaagaaaggagcatggaccaccgaggaggacaagaaactcatctcttacatccacgaccacggcgagggaggctggcgcgacattccccaaaaagctggtttatacaaatctatacatacactcatttttgtacttgttgtagaaaattgttctgataaacatattgtgtctgattagggttgaaacggtgtggaaagagttgtagactgcgatggaccaactaccttaaacctgagatcaaaagaggcgagtttagttcagaggaagagcagattatcatcatgcttcatgcttctcgtggcaacaagtacgtttctatgtttctatgtgtgtgcgtggaccctcgaatgtgaaatgaatttcatgaaaaagttttcatataatatttattatgtagacataatcatcattttaatcttggtctccgatctatcttattttctttaggtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatga

SEQ ID NO: 273 - DNA, 1318 bp, Arabidopsis thaliana
  G202 DNA sequence used for BLAST
tatgaaatgcttttcaagcgagtctgagtcggtgtcatacataaaattggtatggtcaagaagataatttgaccatccctcgaagtttcctaccatattgtcttgatcatcaacgctagttgatgagacttcttgggaaacatcggacataaggagatcattcatactgttctcctcattgtggttatctcctccgaatttttcgaaaaattgtgaaaaatcgtaatcttggtccatgttgagatcagaagtagcattgatctcatgttcggggtacaacgatgatggggagaagggatcaaattcagcaagagtatttgtcagggatgtgttagaactatcctcttcattgcgaatctgctcagtgaagccattaaaaaagcttgcatgtgatattgtagtagcactcaagctaccttccatggaagccgacaatatatctttgatggaagtggccttagccgcaactttgttcaagagccttgatgtagaacttgatttcttgaaacgtttcttgcaactcaaggaactgccttgaatcggtgtcccatcattgctgctaagctcggagaccttggaaaccatgttgcaactggatggaggaggacgagacagaaaaggcattgagctcgatcgggagtattgcttgtcggaactagaggcatttggggaattcaaattctcatcgaccgtagggttggaactagaagccagtggcttgtgagtcacgggatcaataccctgttccatcaaacgttttttgagatgcgtgttccagtagttcttgatctcgttgtctgttcttctaggtaaatgtctcgctatgaccgaccacctaaagaaaataagatagatcggagaccaagattaaaatgatgattatgtctacataataaatattatatgaaaactttttcatgaaattcatttcacattcgagggtccacgcacacacatagaaacatagaaacgtacttgttgccacgagaagcatgaagcatgatgataatctgctcttcctctgaactaaactcgcctcttttgatctcaggtttaaggtagttggtccatcgcagtctacaactctttccacaccgtttcaaccctaatcagacacaatatgtttatcagaacaattttctacaacaagtacaaaaatgagtgtatgtatagatttgtataaaccagctttttggggaatgtcgcgccagcctccctcgccgtggtcgtggatgtaagagatgagtttcttgtcctcctcggtggtccatgctcctttcttcaagccttctccgacgcaacatggctttcttgacat

SEQ ID NO: 274 - DNA, 1046 bp, Arabidopsis thaliana
  G203 cDNA Sequence
ttctcttcccttaatccctaaacccagaaacatgaatccaaatctccttgagaaagatctaagaggtaaggaaactacaaatgggtcaataagatacaaagaagcaaacaacttcagatctctaccaaactcacacactgctgcttgtaaaacttcactcaacaacccctctatctctagaaaccatcctcacaacaaatcagcctcagtcttggagtcggaagatgaacatgggaacgagagaggtgaaaacgaaaagagtttaagaatgaggggcaaaagtggaattaacacaaaagtatgctcacgaggacactggagaccaacagaagatgctaaactcaaggagcttgttgcccagtttggtccccaaaactggaacttgatttctaaccaccttcttggtagatcaggcaagagttgtagattgagatggtttaaccaactagacccaaggattaacaagagggccttcacggaggaagaagagtttaggctgttagcagctcatcgagcctatggcaacaagtgggctttgatctctcgtctctttccaggtcgtaccgataacgctgtcaagaaccattggcacgtcatcatggctcgacggactagagaaagccaaagacaacgtcaacagcctcctccgacgttgtcaagagacgctgaaatgacggtttcgtcctcttgccgctacaatcaaggtaagttcatcaatgaagaagatgacgacgacgatgtgtcagctgtctctacttgtacgacggagctctctctcactccgccttcttcagcttaccagcctcgcttctttaattacgatagtacccttgcatcaggcaaagatggtcagtgtgtgcagagagcagaagtaaatggcatatatggtaaaaagatggaccatcaaaatcaccacaccatctcagtcagtgaaagaaaggtggagatgaagatgaggagtggctattactactttgattttcttggagttggagcttcctgattaattagttgcagagctagggttcaagcggccgcgcgcgcgc

SEQ ID NO: 275 - protein, 323 aa, Arabidopsis thaliana
  G203 Amino Acid Sequence
MNPNLLEKDLRGKETTNGSIRYKEANNFRSLPNSHTAACKTSLNNPSISRNHPHNKSASVLESEDEHGNERGENEKSLRMRGKSGINTKVCSRGHWRPTEDAKLKELVAQFGPQNWNLISNHLLGRSGKSCRLRWFNQLDPRINKRAFTEEEEFRLLAAHRAYGNKWALISRLFPGRTDNAVKNHWHVIMARRTRESQRQRQQPPPTLSRDAEMTVSSSCRYNQGKFINEEDDDDDVSAVSTCTTELSLTPPSSAYQPRFFNYDSTLASGKDGQCVQRAEVNGIYGKKMDHQNHHTISVSERKVEMKMRSGYYYFDFLGVGAS

SEQ ID NO: 276 - DNA, 1825 bp, Arabidopsis thaliana
  G203 Genomic Sequence
atgaatccaaatctccttgagaaagatctaagaggtaaggaaactacaaatgggtcaataagatacaaagaagcaaacaacttcagatctctaccaaactcacacactgctgcttgtaaaacttcactcaacaacccctctatctctagaaaccatcctcacaacaaatcagcctcagtcttggagtcggaagatgaacatgggaacgagagaggtgaaaacgaaaagagtttaagaatgaggggcaaaagtggaattaacacaaaagtatgctcacgaggacactggagaccaacagaagatgctaaactcaaggagcttgttgcccagtttggtccccaaaactggaacttgatttctaaccaccttcttggtagatcaggtacatttattttacttaaaattcttattacttaattatttccttcacttttgttactccaaattccgcaaatttaactatttttatgtagaagaaaaataagtaaatatatttaaaaactttggtgagttgagtttccaaagttattaggcattttcgtaattgtgtttggatttttttaaaaatagtttttacaagttagactaagttgtataaggcataatgacataatgcttgatagtaactaatttttataatgtgagggacacttctttgactacaggcaagagttgtagattgagatggtttaaccaactagacccaaggattaacaagagagccttcacggaggaagaagagtttaggctgttagcagctcatcgagcctatggcaacaagtgggctttgatctctcgtctctttccaggtcgtaccgataacgctgtcaagaaccattggcacgtcatcatggctcgacggactagagaaagccaaagacaacgtcaacagcctcctccgacgttgtcaagagacgctgaaatgacggtttcgtcctcttgccgctacaatcaaggtaagttcatcaatgaagaagatgacgacgacgatgtgtcagctgtctctacttgtacgacggagctctctctcactccgccttcttcagcttaccagcctcgcttctttaattacgatagtacccttgcatcaggtaacattttatttatttgcttaaatattatgtttactatgttttttttttttctctattgaaaatatattattttcatgacccaagacattaaaagtatagaaacttggaatgttttttttcgttttcggctttcttgagaagtgttttcgtgaatctaactataatgatctcggtcggttggtcgagatcgtattgcaatctttattgggtgtatcgttgatcatgatcggtttatactttaaccggtacttccaaatatcatttgtggtctaaatttagcttattagattccagtcttgttaatttttgaatgttcaaagcatataaaatgataatttaggccgacatgttgtataaccgacgacgagtgaccacttcctacactttttcatatacatggcaataattataaatttgaatgactagaaaagaaagaaactgtttttacatcgtaagagtacctataggcataataatataaggaggtgaagtactattgtcacgttactatttcaatataacaaaatttcacgtgggtgctgagaacttatttttctaattttgcaggcaaagatggtcagtgtgtgcagagagcagaagtaaatggcatatatggtaaaaagatggaccatcaaaatcaccacacaatctcagtcagtgaaagaaaggtggagatgaagatgaggagtggctattactactttgattttcttggagttggagcttcctga

SEQ ID NO: 277 - DNA, 1825 bp, Arabidopsis thaliana; identical to SEQ ID NO: 276
  G203 DNA sequence used for BLAST

SEQ ID NO: 278 - DNA, 1231 bp, Arabidopsis thaliana
  G204 Genomic Sequence
actccaaggatgattacggatcctgaacttcaaagctttcatggctgcctttgcaaatatctgagcagcttcagcttctgcttctgctctttctgcctcttttgctgcttgttcagcctctgtgatagcaaattctgcctctgcaactgctcttgctgcagcctctgcagcttcttgagctgtcatgccttttatcatatataattcaccgtctactcggaatttagtgagactgttggcaccgttctcctcgggttttgttgggtctttcttgttgtttccttccagaaagagttgaggagccttctgtcttgcacctgcgggaataaaattagaagaaaacctgtacttgtgctttatctgaaagtgagaaatcaccaagtaagtatttttgaaaattctgagagtaatgaagtgttagtgatcatgaatcttgaatcaaaagttgtgtgtttaccttaactaatgttccattcgatgataaatgctttaatcgtactgcgacatgccttttcatattcggtggagtcttgaaattctcctgaaatttaacagctactaagtaagtatgcaacaaaccccaaccaaacatgtaatcccaatggtagaaatacctctatatacagaaagattgatgttctgtcagaaccgcgtagttccctcaagttggtaattgcctcaaagatgatcttatccaaactacaaaaacagacaatagcgcaagatcaaatctttatgaactcaagaaaatcgttatgtggtgcataagtcagggaaccaaaccttgtaattgatctcttagaagcacaagtgcgtggtgatccaccaccagaacctccgggggaagttggttttgcacgttcatcatcattagtcaaagccacaatggtaagagctgtgttgttatcatcctgtttagtacctggtggagtcctcttaagcgcaagtttagccttcttccttgaaccccataaagctgtcacgcttatatttctccatttgtcctgttatgccttgaactatcaagattagtccgaaacacgcgatcacaacctccaaaaagcatattatattgtattaccttaagatcaacattagagcgagacttaaggattaaactaaactcagtatccgagagtatggtacgccacttcccagtcccatgcttaagaactccagctttaagagctgcttcttcttccggtgtccacttctgctttggtgcacccat

SEQ ID NO: 279 - DNA, 1228 bp, Arabidopsis thaliana
  G204 DNA sequence used for BLAST
ccaaggatgattacggatcctgaacttcaaagctttcatggctgcctttgcaaatatctgagcagcttcagcttctgcttctgctctttctgcctcttttgctgcttgttcagcctctgtgatagcaaattctgcctctgcaactgctcttgctgcagcctctgcagcttcttgagctgtcatgccttttatcatatataattcaccgtctactcggaatttagtgagactgttggcaccgttctcctcgggttttgttgggtctttcttgttgtttccttccagaaagagttgaggagccttctgtcttgcacctgcgggaataaaattagaagaaaacctgtacttgtgctttatctgaaagtgagaaatcaccaagtaagtatttttgaaaattctgagagtaatgaagtgttagtgatcatgaatcttgaatcaaaagttgtgtgtttaccttaactaatgttccattcgatgataaatgctttaatcgtactgcgacatgccttttcatattcggtggagtcttgaaattctcctgaaatttaacagctactaagtaagtatgcaacaaaccccaaccaaacatgtaatcccaatggtagaaatacctctatatacagaaagattgatgttctgtcagaaccgcgtagttccctcaagttggtaattgcctcaaagatgatcttatccaaactacaaaaacagacaatagcgcaagatcaaatctttatgaactcaagaaaatcgttatgtggtgcataagtcagggaaccaaaccttgtaattgatctcttagaagcacaagtgcgtggtgatccaccaccagaacctccgggggaagttggttttgcacgttcatcatcattagtcaaagccacaatggtaagagctgtgttgttatcatcctgtttagtacctggtggagtcctcttaagcgcaagtttagccttcttccttgaaccccataaagctgtcacgcttatatttctccatttgtcctgttatgccttgaactatcaagattagtccgaaacacgcgatcacaacctccaaaaagcatattatattgtattaccttaagatcaacattagagcgagacttaaggattaaactaaactcagtatccgagagtatggtacgccacttcccagtcccatgcttaagaactccagctttaagagctgcttcttcttccggtgtccacttctgctttggtgcacccat

SEQ ID NO: 280 - protein, 246 aa, Arabidopsis thaliana
  G206 Amino Acid Sequence
MGRRPCCEKIGLKKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRLHHSQDQNNKEDFVSTTAAEMPTSPQQQSSSSADISAITTLGNNNDISNSNKDSATSSEDVLAIIDESFWSEVVLTDCDISGNEKNEKKIENWEGSLDRNDKGYNHDMEFWFDHLTSSSCIIGEMSDISEF

SEQ ID NO: 281 - DNA, 1580 bp, Arabidopsis thaliana
  G206 Genomic Sequence
atggggagaagaccatgctgtgagaagataggattgaagaaagggccatggagtgctgaagaagatcgaatcttgatcaattatattagtctccatggccatcccaattggagagctctccctaaactagccggtaaataagccattttatatttgctatttgccatatgtatatattagtaacaaaataattttgtacctagctagcatgtgtattattgttctatagtatatagtagtgtatatttgttgtgtaaagttaataatggtgtttgtgaaatgattagggctacttcggtgcggaaaaagttgcaggcttcgttggattaattatttgagaccagacatcaaacgtggcaatttcactcctcatgaagaagatactatcatcagcttacatcaactcttaggcaacaggtttctcctccttttccattttctgtttttttacttcttcctttgattatatgcgaaattttagattttttggtcctatattctttgaaaccagaaattaaacaagaatttgagaaatcactcacaaatttttctttatttttaatctttgagaagtcaaatcacaagtttttttctttcttttaaagtaagtcaatgcaatttctgtttagtccataactccatatatattacagtgaaaatgatataatgttcatttgtagatgaaggattttgggacatcaaattgtgaaaagtatcattattttggaagtttagtttgttttaactgtggagactagctagctagattactttacaattttctctttgtatatgtgttgcttttgtcaatatgcgagagtttatatctttgtggggcagagaactgagaagattccaacccgtgattgcctttgtccattaaataatttcaattttttactttcctctaattatactttttattcactagtagacaaagataggcactgtgatcagtgtaagacatgtgcaaattcttttaaccatacgcatgaacttcaataacattccttttgttttactcgctctttgttctcataacaatgtagacgacgtattatgatgattgatgagtcattcatgtgacatttgttttgagtagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgacggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttga

SEQ ID NO: 282 - DNA, 1580 bp, Arabidopsis thaliana
  G206 DNA sequence used for BLAST
atggggagaagaccatgctgtgagaagataggattgaagaaagggccatggagtgctgaagaagatcgaatcttgatcaattatattagtctccatggccatcccaattggagagctctccctaaactagccggtaaataagccattttatatttgctatttgccatatgtatatattagtaacaaaataattttgtacctagctagcatgtgtattattgttctatagtatatagtagtgtatatttgttgtgtaaagttaataatggtgtttgtgaaatgattagggctacttcggtgcggaaaaagttgcaggcttcgttggattaattatttgagaccagacatcaaacgtggcaatttcactcctcatgaagaagatactatcatcagcttacatcaactcttaggcaacaggtttctcctccttttccattttctgtttttttacttcttcctttgattatatgcgaaattttagattttttggtcctatattctttgaaaccagaaattaaacaagaatttgagaaatcactcacaaatttttctttatttttaatctttgagaagtcaaatcacaagtttttttctttcttttaaagtaagtcaatgcaatttctgtttagtccataactccatatatattacagtgaaaatgatataatgttcatttgtagatgaaggattttgggacatcaaattgtgaaaagtatcattattttggaagtttagtttgttttaactgtggagactagctagctagattacttcacaattttctctttgtatatgtgttgcttttgtcaatatgcgaaattttatatctttgtggggcagagaactgagaagattccaacccgtgattgcctttgtccattaaataatttcaattttttactttcctctaattatactttttattcactagtagacaaagataggcactgtgatcagtgtaagacatgtgcaaattcttttaaccatacgcatgaacttcaataactttccttttgttttactcgctctttgttctcataacaatgtagacgacgtattatgatgattgatgagtcattcatgtgacatttgttttgagtagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgatggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttga

SEQ ID NO: 283 - DNA, 1107 bp, Arabidopsis thaliana; identical to SEQ ID NO: 63
  G207 cDNA Sequence

SEQ ID NO: 284 - protein, 304 aa, Arabidopsis thaliana
  G207 Amino Acid Sequence
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 285 - DNA, 906 bp, Arabidopsis thaliana
  G207 Genomic Sequence
ctactcaaccttaggtgttattactccacaatccctaaaaccaccattgccgccggattcgtataaacctccgacgacgaatccaccacttgttttctgcatttccgccatgtaactcctcacttcagcttttatcatctcctgcaccaccgtcataaactcacctctacgtccttctcctctctcctctacattaatcttcatctgactctcaaatctcggaaacatcaacgcgttgttgttattgttatggctcgaactcgtgttctcagctccaggtagtgacaaactcaacgaagtaggtggatcctccgaagacgaagacatttcaaccggtaacggctgcggaaccaccgtaaaaccgccggaaatcggcattggtttaaacagctgagcaacaggagacgacggtgacggaatcgtgctagaatcactaacatcgattccgttaggactctcaggactcatgtacaatccagtatccaccggagcaaaagcagaatcaaagctaacagatctcctcttcttcggccgatcctgatcttcctccgtctccgtcaccgtcgtaaccgccacacctccgctgcatttcctcttaagcgtagagttccagtgatttttaacggcgttatccgtacgaccgttaagaagacgagcaatcgtcgcccacttgttaccaaactgagcacgggcggttacaatagtctcatcttcctccggcgagaaaggacgatgctcaacctccggagataactgattacaccaacgtaatctacacgatttaccagatcgacctggaatcgatttgctaatcgcagaccaattcctcggtccgtatttctcaaccatccttcgtagctgctcatcttcttcttgactccatggacctttaacacgatccgccat

SEQ ID NO: 286 - DNA, 906 bp, Arabidopsis thaliana; identical to SEQ ID NO: 285
  G207 DNA sequence used for BLAST

SEQ ID NO: 287 - DNA, 764 bp, Arabidopsis thaliana; identical to SEQ ID NO: 102
  G208 cDNA Sequence

SEQ ID NO: 288 - protein, 236 aa, Arabidopsis thaliana
  G208 Amino Acid Sequence
MGRSPCCEKAHTNKGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKLLSHGIDPQTHRQINESKTVSSQVVVPIQNDAVEYSFSNLAVKPKTENSSDNGASTSGTTTDEDLRQNGECYYSDNSGHIKLNLDLTLGFGSWSGRIVGVGSSADSKPWCDPVMEARLSLL

SEQ ID NO: 289 - DNA, 1110 bp, Arabidopsis thaliana
  G208 Genomic Sequence
accatcttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaagtacgataactttttcctctctttctcttcttctaaaaaaacagagtgaaaatagaaaaacagagtcacttttttttttctccctactcttgtttctaggaaaaagatttcaactttctaggaaacagagagaaaatagaaactgggtcactttgttttcctgctctttcttcttctttgatctttcccaggaaaaaagtttcaactttctaggaaacagagtcgttcacttttttgtttcctctgtttttgttaaagctttcctctgttattgttattcatatgaatttgaaatgttttgttttgcagatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaataatttgtcaaaaaaatcccaaaaaatgggttttgttacttcatttttttttttgcttgagtccttttgga

SEQ ID NO: 290 - DNA, 1020 bp, Arabidopsis thaliana
  G208 DNA sequence used for BLAST
ttacaacagtgacaaacgcgcctccatcaccgggtcgcaccacggtttagaatcagccgatgacccgactccgactatccgacccgaccaggatccaaacccaagagttaaatccaaattcagctttatatgtcctgaattatcactataataacactccccattctgccggagatcctcgtccgtcgtcgtgccgctagtcgaagctccgttatcggaggaattttccgtcttcggtttaacggctaaattggaaaaagaatactcaacggcatcgttttgaataggaacaacaacttgagacgacaccgttttggattcgttaatctgacgatgagtttgtggatcaataccgtgactaagaagcttcctcttaatatgagtgttccaataattctttatttcgttatctgttcttcctggtaatcttccagctatcaatgaccatctgcaaaacaaaacatttcaaattcatatgaataacaataacagaggaaagctttaacaaaaacagaggaaacaaaaaagtgaacgactctgtttcctagaaagttgaaacttttttcctgggaaagatcaaagaagaagaaagagcaggaaaacaaagtgacccagtttctattttctctctgtttcctagaaagttgaaatctttttcctagaaacaagagtagggagaaaaaaaaaagtgactctgtttttctattttcactctgtttttttagaagaagagaaagagaggaaaaagttatcgtacttgttaccgagtaagctatggagtttgatgatgatttgatcttcatcatcagtaaaattaccacgtttaagatcaggacgaaggtaattaatccatctcaatctacaacttttaccacaacgcaacaatccagcggatttaggaagagaacgccaacaaccttcaccgtgattacggatataatctacgagacgttgatcttcttctttagtccaagctcctttgtttgtgtgagctttttcacaacaaggagatcttcccat

SEQ ID NO: 291 - DNA, 918 bp, Arabidopsis thaliana
  G209 cDNA Sequence
tcaacccaccagtccaagtcaaacctcctcaagccatcccctaatcctatatatcagtttcttctcgcaaaccacctcacaatctatcaacagttttaaaaaaagacataactcaaccaatctcactttgaaaaagacatgaacaaaacccgccttcgtgctctctccccaccttccggtatgcaacaccgtaagagatgtcgattgagaggtcgaaactacgtaaggccagaagttaaacaacgcaacttctcaaaagatgaagacgatctcatcctcaagcttcatgcacttcttggcaatagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttgtagacgccacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccgctctttgccttcaggactctagcgaatcctctaccaatggttcaacaggtcaagaaacgcttcttctattccgatgagaaatggtgtatttctttgtacacatttgttatattacaaatgcacatattataatattcactagagagatggtataacgatgtttgaaatatgttaatcctgaattggaccggctggtcattgaacaactattctcttaaatgtccggttctgttttcagtgattagtattatagtagatcgttaataacta

SEQ ID NO: 292 - protein, 213 aa, Arabidopsis thaliana
  G209 Amino Acid Sequence
MNKTRLRALSPPSGMQHRKRCRLRGRNYVRPEVKQRNFSKDEDDLILKLHALLGNRWSLIAGRLPGRTDNEVRIHWETYLKRKLVKMGIDPTNHRLHHHTNYICRRHLHSSHKEHETKIISDQSSSVSESCGVTILPIPSTNCSEDSTSTGRSHLPDLNIGLIPAVTSLPLFAFRTLANPLPMVQQVKKRFFYSDEKWCISLYTFVILQMHIL

SEQ ID NO: 293 - DNA, 899 bp, Arabidopsis thaliana
  G209 Genomic Sequence
atgaacaaaacccgccttcgtgctctctccccaccttccggtaactattttctctttaaacagtattaatcatgtgttttgctattcacatcaccaaattattcatagtttaaagaggtcgatgtagaattcatagatatacatgtgtacatacgtgactttgtgacgatatatcgttttaatttgttaaattttgatcccttctcttaggtatgcaacaccgtaagagatgtcgattgagaggtcgaaactacgtaaggccagaagttaaacaacgcaacttctcaaaagatgaagacgatctcatcctcaagcttcatgcacttcttggcaataggttcgtattcattcttcttattctttaattcaatagtaatgtgaacggtacgtgctaataatcattttgatgttatgttttttcagatggtcattgatagcgggaagattgccaggacgaaccgacaacgaagttaggatccattgggaaacttacctaaaaaggaagctcgtaaaaatgggaatcgacccaaccaatcatcgtctccaccatcacaccaactacatttctagacgtcacctccattcttcacataaggaacatgaaaccaagattattagtgatcaatcttcttcggtatccgaatcatgtggtgtaacaattttgcccattccaagtaccaattgctcggaggatagtactagtaccggacgaagtcatttgcctgacctaaacattggtctcatcccggccgtgacttctttgccagctctttgccttcaggactctagcgaatcctctaccaatggttcaacaggtcaagaaacgcttcttctattccgatgagaaatggtgtatttgtttgtacacatttgttatattacaaatgcacatattataa

SEQ ID NO: 294 - DNA, 899 bp, Arabidopsis thaliana; identical to SEQ ID NO: 293
  G209 DNA sequence used for BLAST

SEQ ID NO: 295 - DNA, 1252 bp, Arabidopsis thaliana
  G210 cDNA Sequence
tcagaacacaaaagtttggctacagttgtgttctgatagtgatgatcatgatcatcacatgaataagtagaagatatctcttaccttctccttcttctaataagatcagagttttggttcttatttctttgacctctcaaaacaatgggtagatcaccgtgttgtgacaaattgggtttgaagaaaggaccttggacaccagaggaggatcagaaacttttagcttatattgaagaacatggtcatggaagttggcgttcattgcctgagaaagctggtctccatcgatgcggaaagagttgtagactaagatggactaactacctaagacctgacatcaaaagaggcaaattcaacttacaagaagaacaaaccattatccaactccatgctctgttaggaaacagatggtcagcgattgctactcatttgccaaagagaacagacaacgagatcaagaactattggaacactcatttgaagaaacggttagtgaaaatggggattgatccagtgactcataaacccaaaaacgagactcctttatcttctcttggtctatccaagaacgcagctatacttagccacactgctcaatgggaaagtgcaaggcttgaagctgaagcaagactagctagagaatcaaagcttcttcatttacaacattaccaaaccaaaacatcatctcaacctcatcatcatcatggattcactcacaagtcattgttacctaattggacaacaaaaccacacgaagatcaacaacagcttgaatctccgacatctacagtgtcattctctgagatgaaggaatcaatcccggcgaagatagagtttgtcggatcatcaactggtgtgactctgatgaaagaacctgaacacgattggatcaattcaacgatgcacgagtttgaaactacgcagatgggagaaggaatcgaagaagggttcacgggtctcttgctcggtggtgattcaatcgaccggagtttttccggcgataaaaacgagacggccggcgagagtagtggtggtgactgcaactactatgaggacaacaagaactacttggacagcattttcaactttgtagatccttcaccgtcggattcaccgatgttctgaatctaagggttgatatttgttgggaatgtttttgattctttttttagtttctagtttttgtgcttaaactctgattagacaatttttaaactaatccaatttttgcgctaaaaaaaaaaaaaaaaaa

SEQ ID NO: 296 - protein, 326 aa, Arabidopsis thaliana
  G210 Amino Acid Sequence
MGRSPCCDKLGLKKGPWTPEEDQKLLAYIEEHGHGSWRSLPEKAGLHRCGKSCRLRWTNYLRPDIKRGKFNLQEEQTIIQLHALLGNRWSAIATHLPKRTDNEIKNYWNTHLKKRLVKMGIDPVTHKPKNETPLSSLGLSKNAAILSHTAQWESARLEAEARLARESKLLHLQHYQTKTSSQPHHHHGFTHKSLLPNWTTKPHEDQQQLESPTSTVSFSEMKESIPAKIEFVGSSTGVTLMKEPEHDWINSTMHEFETTQMGEGIEEGFTGLLLGGDSIDRSFSGDKNETAGESSGGDCNYYEDNKNYLDSIFNFVDPSPSDSPMF

SEQ ID NO: 297 - DNA, 1213 bp, Arabidopsis thaliana
  G210 Genomic Sequence
atgggtagatcaccgtgttgtgacaaattgggtttgaagaaaggaccttggacaccagaggaggatcagaaacttttagcttatattgaagaacatggtcatggaagttggcgttcattgcctgagaaagctggttagtgaatctttccacattttgtgctctataatcaaaactttctctcatatttattcctttctcttctcaggtctccatcgatgcggaaagagttgtagactaagatggactaactacctaagacctgacatcaaaagaggcaaattcaacttacaagaagaacaaaccattatccaactccatgctctgttaggaaacaggtctggtccttcttgcaacaaaacaaaacaatcacaaatcttttcctaaagttttcatgattctttttttgtttgtatatagatggtcagcgattgctactcatttgccaaagagaacagacaacgagatcaagaactattggaacactcatttgaagaaacggttagtgaaaatggggattgatccagtgactcataaacccaaaaacgagactcctttatcttctcttggtctatccaagaacgcagctatacttagccacactgctcaatgggaaagtgcaaggcttgaagctgaagcaagactagctagagaatcaaagcttcttcatttacaacattaccaaaccaaaacatcatctcaacctcatcatcatcatggattcactcacaagtcattgttacctaattggacaacaaaaccacacgaaggtaaaccaaagaaacacactaagtctccgcaaaatttaaactttggaactttgtttgagttttgtaagacaatgcagatcaacaacagcttgaatctccgacatctacagtgtcattctctgagatgaaggaatcaatcccggcgaagatagagtttgtcggatcatcaactggtgtgactctgatgaaagaacctgaacacgattggatcaattcaacgatgcacgagtttgaaactacgcagatgggagaaggaatcgaagaagggttcacgggtctcttgctcggtggtgattcaatcgaccggagtttctccggcgataaaaacgagacggccggcgagagtagtggtggtgactgcaactactatgaggacaacaagaactacttggacagcatttttaactttgtagatccttcaccgtcggattcaccgatgttctga

SEQ ID NO: 298 - DNA, 1213 bp, Arabidopsis thaliana; identical to SEQ ID NO: 297
  G210 DNA sequence used for BLAST

SEQ ID NO: 299 - protein, 228 aa, Arabidopsis thaliana
  G212 Amino Acid Sequence
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSRHHQQENIYENIAKSFNGVVSASYEDKPKQELAQKDVLMATTNDPSHYYGNNALWVHDDDFELSSLVMMNFASSDIEYCL

SEQ ID NO: 300 - DNA, 3614 bp, Arabidopsis thaliana
  G212 Genomic Sequence
tcaattaaagagggtaacctcatgaacttttaaaaagtatgtcgaaaagttgactataatttgagaaacaagacatggaaaggagaaccatttcattgatccatcaaagtttcttttttcatgttttgtcttctgcaaaaaaactgttttagggtgaactctgtggtacttttaaataggttgttccgatcccactttgttgtataaataactaaaaataatatctagttccaatgaaaaagatcattatcaaatattagtagaatgtaagtgtatacagtgcataaacaaactggttaacgtgtcaaataaattacaaatcagttaaatcatacaatatagaacatttcgcagtaatctgccccatatttagtagatttgtttttgtaaatttcatgtcgcaagtatagtatttagatattgccagaggagaaaaaacaatttttttataaattttttggccatagatacaattaaaccaactgccaaattttagcttttaatacgtaacgtagggtaacaaaggataacgctatagtcgctatctatacattattaggtacatatttatgcttatagccatgattacacaaagatacgtattgatgtgagtgtatatataagcacgtgtcacgaaaacccatcataagttcactactcataatctctttctctctctcacacacacacacacacagacacacacaaacatagaaggaatcagagaataaaaaaagaatgagaataaggagaagagatgaaaaagagaatcaagaatacaagaaaggtttatggacagttgaagaagacaacatccttatggactatgttcttaatcatggcactggccaatggaaccgcatcgtcagaaaaactggtactctttctctctctcgttttgtgattatatatattaactttagtctctagctagttcatatataaatatatctcagttagactaaatttgattcgttgatagggctaaagagatgtgggaaaagttgtagactgagatggatgaattatttgagccctaatgtgaacaaaggcaatttcactgaacaagaagaagacctcattattcgtctccacaagctcctcggcaataggtacataactttatgttactacaatattatacaccatgtctttttatttaatcgatcgttaactgattttttctttcgtcaaatatttgaattgttgttttaaacaaagatttggccggttaagttgatttttaaaaatctaattgaaggattttcttacttgcaaatgtaaaaataaagagagttgacaagtaaagactgttttatttcaattaaactatgtgttcgtggattatttcacatttcaaaaggtgttttcttcacaaaataaatcttaaaaataatcctttgaacttaaaatatgttcaaattttcaagttgatatatttttctgaagaagaaaagagttgcacaagataaaagtttgtcttctcttcaatgaaactcaaccgatgtgttggtgggttatttcaattttaaaaggtgtttcctccaaaaacaaatctttaagagtatcttttgaacttaaatatgttcgaacatttcaagtggatatatttaatgaataatagcactttttcataagtgtattagtcgttgcaaacagtcacttctcaaaattcattatagagttagaaacgttttccacaattgaaaaataaaaataaaaaatcctctctatgtatataaatatgcattcatttatgaatcacatacagatgtcgaaataataaaaagaatcataaacatatggtatgttataatttatgttatatggtatgaatttaataaaaatgtcctataatatttttttcccaaattcagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttctcgtcatcatcaacaagaaaatatctacgagaatatagccaagagctttaacggcgtcgtatcagcttcgtacgaggataaaccaaaacaagaactggctcaaaaagatgtcctaatggcaactactaatgacccaagtcactattatggcaataacgctttatgggttcatgacgatgattttgagcttagttcactcgtaatgatgaattttgcttctagtgatattgagtactgcctttagtttaattgttcatgttttgaaattgtctttgaatttttgagataaaataacaattaattatggatactaataagtaatatcgatatcaatactaccactattacaatctaggagtacgtacttctttatactattcaaagagtaataaattttaccgaatgtaaaaaataagttagttaccgcggatactgaatgagttttactaattactcatatatatatttcttggataaagtttaaacgatttttatctttaataatgcgaataaaaagtagtacgaatatataagtttcataacataatggaaaacaatttcctttagtttgcatatatataaatatatatatctgatttttacttaaattggaataaaagattgtcaaagaaagagaagtttaatcacgcttattgacgttcatctcttgaagttaaaattttctcttaaggttatcgagaagttactgcctttatttcatatatagtctcttcggatcatggactagaacacattttttatcaaccactgattcatcagattacttaaagttgatacataaattaaagtggaaaaggttcacttaaccctttttcagaagaagacttaaacatcaaaaagacaacgaaaatattattatttttacaatattgtcgcgaagagcctcatgcatgtggtgttacgctgttaaaattaaaaacaagagagttagttgagacgccaaaagaaatgttgaatgttccaaaaataaaataaaatagatattattattataggatctattattattattcctatttgtaataaatttgtactctcacatttcagctaacaacaaagttgtgtgatctctgaccacgttgtgttgatatcttccgcgtaggttttcatttacactataaactatataaattggtcattaattactcaaacatttatatatgattcgtgtatttttttggtatttatatttctttcacatattgttgcgtcgtagttaatttacacataggggcatacatgcgtacgggtcgttgacacgtctatttattattaaccatactgggtacgtagtaaatttcatcagaagggacacacaaagtaagatagcagcaataattgagttgaaattaaaccacatgttttctcttttaaatatctggttttcaaaacagtagtaatctttgcgcgggaatttcgacatcaaaactatgagtttaacaaaaagaatcactaattagaacatcaaaatgaaaatgacatatagaactaaatttctttgcaaaaattttgcattcgaaatgtaaacatacataatttttg

SEQ ID NO: 301 - DNA, 1562 bp, Arabidopsis thaliana
  G212 DNA sequence used for BLAST
ctaaaggcagtactcaacatcaccagaagcaaaattcatcattacgagtgaactaagctcaaaatcgtcgtcatgaacccataaagcgttattgccataatagtgacttggatcattagtagttgccattaggacatctttttgagccagttcttgttttggtttatcctcgtacgaagctgatacgacgccgttaaagctcttggctatattctcgtagatattttcttgttgatgatgacaagaagaaggtgtggcggcagtgatgaacaatgacggtggagagtcgtcgtcttctccggtggttttgacggcggaggagtaatctccgacgagttttttgctgagatgagtgttccagtagttcttgacttggttatctgttcttcccggtactcttttagctatcaaagaccatctgaatttggggaaaaaatattataggacatttttattaaattcataccatataacataaattataacataccatatgtttatgattctttttattatttcgacatctgtatgtgattcataaatgaatgcatatttatatacatagagaggattttttatttttatttttcaattgtggaaaacgtttctaactctataatgaattttgagaagtgactgtttgcacgactaatacacttatgaaaaagtgtctattattcattaaatatatccacttgaaatgttcgaacatttttaagttcaaaagatactcttaaagatttgtttttggaggaaacaccttttaaaattgaaataacccaccaacacatcggttgagtttcattgaagagaagacaaacttttatcttgtgcaactcttttcttcttcagaaaaatatatcaacttgaaaattttgaacatattttaagttcaaaggattatttttaagatttattttgtgaagaaaacaccttttgaaatgtgaaataatccacgaacacatagtttaattgaaataaaacagtctttacttgtcaactctctttatttttacatttgcaagtaagaaaatccttcaattagatttttaaaaatcaacttaaccggccaaatctttgtttaaaacaacaattcaaatatttgacgaaagaaaaaatcagttaacgatcgattaaataaaaagacatggtgtataatattgtagtaacataaagttatgtacctattgccgaggagcttgtggagacgaataatgaggtcttcttcttgttcagtgaaattgcctttgttcacattagggctcaaataattcatccatctcagtctacaacttttcccacatctctttagccctatcaacgaatcaaatttagtctaactgagatatatttatatatgaactagctagagactaaagttaatatatataatcacaaaacgcgcgagagagagaaagagtaccagtttttctgacgatgcggttccattggccagtgccatgattaagaacatagtccataaggatgttgtcttcttcaactgtccataaacctttcttgtattcttgattctctttttcatctcttctccttattctcat

SEQ ID NO: 302 - DNA, 2240 bp, Arabidopsis thaliana; identical to SEQ ID NO: 35
  G214 cDNA Sequence

SEQ ID NO: 303 - protein, 608 aa, Arabidopsis thaliana
  G214 Amino Acid Sequence
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 304 - DNA, 3220 bp, Arabidopsis thaliana
  G214 Genomic Sequence
ctgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaaggtacttaagattgatttattgtcatggtctttcttattgtttgatgaataacttgacttgattgttttttgttttgtggattagtggaattttgtaaagagaagatctgaagttgtgtagaggagcttagtgatggagacaaattcgtctggagaagatctggttattaaggtaaattaaactaaattttagggggaagatgattgttttaggtgtcaaagattgagaattttaatgaaacttgatatagactcggaagccatatacgataacaaagcaacgtgaaaggtggactgaggaagaacataatagattcattgaagctttgaggctttatggtagagcatggcagaagattgaaggttgatttttatttccctttatatgtcttattttttgtgtttgcagaggtttgtcttcaaactgatttgctttttttcatttggacagaacatgtagcaacaaaaactgctgtccagataagaagtcacgctcagaaatttttctccaaggtaaaatcggttaattttgaaatgatgttctcatcttcattggcttaatgcttaagacttattgaaagccaggcaagttttctgcttcttttgcttcttagtcaggagatagatagattacgtttttagagtttagtaatgagcaataagtcttaaaatagttggagaaatgacgagatgtaatcgttttcttttgtttatgcctatatcttgttaatccacaaacatgtacatagattcttcagaagaatgttagtttctttagattcttcagataaacttgtgtcttcttaccgattctgaggtagtggcaaaagtgggctgagtgctagaaatttttgaatgttccttgtgataagccatagaggtaaaccatttttgattttccagttctgtcatttaaacttgttagtgtcattagatttttgtttgtttacgtttgtttagagggtaacaaaactactctcatctctctcaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgaggtgattttcatggtcatatggcatctttttgcagtgtgtcacattgctcctcatgttattaatacagattgtgtgcttcgtttatagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagaggtaaaaaacaatctttcattgctatttgaggttttaagacgattagtacttttcatgaaactaaaaccgtgggggaataacagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgaggtacttacttggactaaagatcaacttcctttatttcaaatcattttctcatataaatattgtacattcagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttccaacctggaaa

SEQ ID NO: 305 - DNA, 2713 bp, Arabidopsis thaliana
  G214 DNA sequence used for BLAST
atggagacaaattcgtctggagaagatctggttattaaggtaaattaaactaaattttagggggaagatgattgttttaggtgtcaaagattgagaattttaatgaaacttgatatagactcggaagccatatacgataacaaagcaacgtgaaaggtggactgaggaagaacataatagattcattgaagctttgaggctttatggtagagcatggcagaagattgaaggttgatttttatttccctttatatgtcttattttttgtgtttgcagaggtttgtcttcaaactgatttgctttttttcatttggacagaacatgtagcaacaaaaactgctgtccagataagaagtcacgctcagaaatttttctccaaggtaaaatcggttaattttgaaatgatgttctcatcttcattggcttaatgcttaagacttattgaaagccaggcaagttttctgcttcttttgcttcttagtcaggagatagatagattacgtttttagagtttagtaatgagcaataagtcttaaaatagttggagaaatgacgagatgtaatcgttttcttttgtttatgcctatatcttgttaatccacaaacatgtacatagattcttcagaagaatgttagtttctttagattcttcagataaacttgtgtcttcttaccgattctgaggtagtggcaaaagtgggctgagtgctagaaatttttgaatgttccttgtgataagccatagaggtaaaccatttttgattttccagttctgtcatttaaacttgttagtgtcattagatttttgtttgtttacgtttgtttagagggtaacaaaactactctcatctctctcaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgaggtgattttcatggtcatatggcatctttttgcagtgtgtcacattgctcctcatgttattaatacagattgtgtgcttcgtttatagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagaggtaaaaaacaatctttcattgctatttgaggttttaagacgattagtacttttcatgaaactaaaaccgtgggggaataacagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgaggtacttacttggactaaagatcaacttcctttatttcaaatcattttctcatataaatattgtacattcagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatga

SEQ ID NO: 306 - protein, 369 aa, Arabidopsis thaliana
  G215 Amino Acid Sequence
MTRRCSHCSNNGHNSRTCPTRGSGSSSAVKLFGVRLTDGSIIKKSASMGNLSALAVAAAAATHHRLSPSSPLATSNLNDSPLSDHARYSNLHHNEGYLSDDPAHGSGSSHRRGERKRGVPWTEEEHRLFLVGLQKLGKGDWRGISRNYVTSRTPTQVASHAQKYFIRHTSSSRRKRRSSLFDMVTDEMVTDSSPTQEEQTLNGSSPSKEPEKKSYLPSLELSLNNTTEAEEVVATAPRQEKSQEAIEPSNGVSPMLVPGGFFPPCFPVTYTIWLPASLHGTEHALNAETSSQQHQVLKPKPGFAKERVNMDELVGMSQLSIGMATRHETETSPSPLSLRLEPSRPSAFHSNGSVNGADLSKGNSAIQAI

SEQ ID NO: 307 - DNA, 1570 bp, Arabidopsis thaliana
  G215 Genomic Sequence
ttagatagcctgaatcgcgctgttgcctttactcaaatctgcaccattaaccgagccattcgagtgaaacgctgatggccttgagggctctagtctcaaagatagcggggaaggggaagtttcggtttcgtgtcttgtcgccattcctatgctaagctgagacataccgaccaactcgtccatgttcacacgttctttagcaaatccaggttttggttttaggacctgatgctgctgagaagaagtctcagcgtttaaggcatgttctgttccgtgaagtgacgcagggagccaaatcgtgtaagtcactggaaaacaaggaggaaagaagccacccgggactagcattggtgaaacaccatttgatggttctatagcttcttgagatttttcctgtcgtggcgccgtggctacgacctcttcagcttctgtggtattattgagtgagagctcaagtgaaggaaggtagcttttcttttcaggttccttgcttggagaggaaccgtttaaggtctgctcttcctgtgttggcgatgaatcggttacctaaatgcggcaaaaacagaggagacattcaatacaagtttccaaacatttccatagaataagaaaaatcatgaagaaaagatactaaccatctcatctgtaaccatgtcgaagaggctagaccgtcttttcctgcggcttgaactagtatgtcgaataaaatacttttgagcatgactagccacttgtgtaggagttcttgacgttacatagtttctcgaaataccgcgccaatctcctttcccgagtttctgaagaccgactaagaatagtctatgttcctcttcagtccaaggaacacctgttacaccaaatatacatgtaaaaaccatatcacatttaagaatacaaaacctttcatcttcttaaactaaaattcaacaatatgattcacaatgagatatgttttgataagcacttaagtccaacacaagtatctaagcatccaacactaagttgttcccaacaattccactcaccagtaagatctaaatccattcaatttctagcaataacctttactaatgtcaaagtaaaacctttagagcaatttcaaattcaaagttccaaactttactatgaatatgcaacaatcgattattaagtcgtttcctttacctctcttcctctcaccacgacggtgactagacccagaaccatgagcaggatcatcagataaatacccttcattatgatgcaaattagagtatcgggcatgatccgataacggcgaatcattaagatttgacgtcgccagaggagacgacggagataaacggtggtgcgttgccgccgccgccgcaacagccaatgccgagagattacccatactcgcactctttttaataatcgagccatccgttaacctcacaccaaataacttcacggcggaggaggaaccagaccctcctccaccaccacctcctcctcctccgccacttccaccgcacgtgccaccaccacgcgttggacacgtgcgtgaattgtgcccattgttgctacaatgcgaacaccgacgagtcat

SEQ ID NO: 308 - DNA, 1570 bp, Arabidopsis thaliana; identical to SEQ ID NO: 307
  G215 DNA sequence used for BLAST

SEQ ID NO: 309 - protein, 367 aa, Arabidopsis thaliana
  G216 Amino Acid Sequence
MNGEISRPPELISSRNPCKSFENAIHKAVEAELAELAKSDANGGGKSKVKGPWLPEQDEALTRLVKMCGPRNWNLISRGIPGRSGKSCRLRWCNQLDPILKRKPFSDEEEHMIMSAQAVLGNKWSVIAKLLPGRTDNAIKNHWNSNLRRKPAEQWKIPLLMSNTEIVYQLYPSMVRRISNASPKEHLPQEEETGVLSDDKMDDEAKEPPREQNSKTGVYRPVARMGAFSVCKPGYMAPCEGPLVQASRPDSLAGKFLQSLCYDPIIPSKCGHGCCNHQDSTTLSSSSVLGSEFVDYEEHSSAELDKELISISNDLNNTAWIRSGKEAEQSLKADDQFRREYAHSKFSGMVNNGVSSQMVRQDLRALS

SEQ ID NO: 310 - DNA, 1535 bp, Arabidopsis thaliana
  G216 Genomic Sequence
ttagctcaaagcccttaaatcttgtctcaccatctgacttgatacaccattgtttaccattccactaaatttcgagtgagcatactcacgacgaaactgatcatcagccttcaaactctgttcagcttccttcccactcctaatccaagcagtattgttcaggtcatttgatatagagatcaattctttatctaactctgcagaagaatgttcctcataatccacaaactctgatcccagcaccgacgatgatgacagtgttgtgctgtcttgatggttgcagcaaccgtgaccgcattttgaagggataataggatcataacaaagagactgaagaaatttaccagccaatgagtcaggtcttgatgcttgaaccaaaggtccctcacatggagccatgtatcctggtttacagacactgaaagcacccattcgagccactggacgataaacaccagttttactattttgctcccgaggaggctcctttgcttcatcatccattttatcatcacttaatacaccggtttcttcttcttgaggtagatgttctttgggggatgcgtttgatatccttctgaccattgatggatacagttgatatactatctctgtattagacatcaatagaggaatcttccattgttctgctggtttacgtctaagattagagttccaatgattcttaatggcattatctgttctcccaggtaagagtttagcaatcacagaccatttgttcccaagaaccgcctgtgcagacattatcatatgctcctcctcatctgcatttcaaatcattttcataaaaacattatacaaacatgtgaaaacacataactcacacactaatcatcaaaaaccacatctctaaagaattacaacataaacatcttgaatccaagagaatgctaaaacctattaaaccatctccatatacataagaatctgattctgaagaaaagttcatatccagtaaaatcaccagcaaaacagaccaatctacaaatctctcacaaatttttcaaaaataagctaaaacaccgcttctcattagcactactgagaaaatcatatgaatcaagtaccacaacaaagatcctgaatcaacaatagctaacactagacatagataaagagaaatccagagaaatcgaccaaagcaggaatctggaatcaaggagaatcaaaaagaagatcgagaatcgtgttttaccagagaaaggttttcgtttgaggataggatcgagctgattacaccaacgtaatcggcaagatttaccagagcgacctgggattccacgggagattagattccagttcctcggcccacacattttcacaagcctcgtgagagcctcatcttgctccggcaaccaaggtcctttcactttactctttccgccgccgttcgcgtcgcttttcgctagctcggcgagctctgcctcaactgctttgtgtattgcattttcaaaactcttgcaaggattccgggacgatattagctccggcggacgagagatttctccgttcat

SEQ ID NO: 311 - DNA, 1535 bp, Arabidopsis thaliana; identical to SEQ ID NO: 310
  G216 DNA sequence used for BLAST

SEQ ID NO: 312 - DNA, 2807 bp, Arabidopsis thaliana
  G217 cDNA Sequence
cttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcagcaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgtattggtaagtttttttaatatgagtcatgactttgtaaaaaggttatgatatattctctgtttgtatgctttgcaagagtcaagaaatttgaatgcttcaggatcaaaaaaaaaaaaaaaaaaaaaaaaaaaaaa

SEQ ID NO: 313 - protein, 844 aa, Arabidopsis thaliana
  G217 Amino Acid Sequence
MRIMIKGGVWKNTEDEILKAAVMKYGKNQWARISSLLVRKSAKQCKARWYEWLDPSIKKTEWTREEDEKLLHLAKLLPTQWRTIAPIVGRTPSQCLERYEKLLDAACTKDENYDAADDPRKLRPGEIDPNPEAKPARPDPVDMDEDEKEMLSEARARLANTRGKKAKRKAREKQLEEARRLASLQKRRELKAAGIDGRHRKRKRKGIDYNAEIPFEKRAPAGFYDTADEDRPADQVKFPTTIEELEGKRRADVEAHLRKQDVARNKIAQRQDAPAAILQANKLNDPEVVRKRSKLMLPPPQISDHELEEIAKMGYASDLLAENEELTEGSAATRALLANYSQTPRQGMTPMRTPQRTPAGKGDAIMMEAENLARLRDSQTPLLGGENPELHPSDFTGVTPRKKEIQTPNPMLTPSMTPGGAGLTPRIGLTPSRDGSSFSMTPKGTPFRDELHINEDMDMQQSAKLERQRREEARRSLRSGLTGLPQPKNEYQIVAQPPPEESEEPEEKIEEDMSDRIAREKAEEEARQQALLKKRSKVLQRDLPRPPAASLAVIRNSLLSADGDKSSVVPPTPIEVADKMVREELLQLLEHDNAKYPLDDKAEKKKGAKNRTNRSASQVLAIDDFDENELQEADKMIKEEGKFLCVSMGHENKTLDDFVEAHNTCVNDLMYFPTRSAYELSSVAGNADKVAAFQEEMENVRKKMEEDEKKAEHMKAKYKTYTKGHERRAETVWTQIEATLKQAEIGGTEVECFKALKRQEEMAASFRKKNLQEEVIKQKETESKLQTRYGNMLAMVEKAEEIMVGFRAQALKKQEDVEDSHKLKEAKLATGEEEDIAIAMEASA

SEQ ID NO: 314 - DNA, 3121 bp, Arabidopsis thaliana
  G217 Genomic Sequence
atgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaaggtaagtcgtgttcgcgttttccttctcttaactagtagtgttcgaaaaaaaactatggatctggcgaacatttttttgtttggggatttggccttttaggtagtttgttagcttgttactaggtgctttagttgtatatatgtattgatttgcatctggaaattcatagaaagtgtaggcagtaatgctaggagttttggagtattcgaaggttttcttatgtttttgaattacaactgagtttaattttgtgatgttaatgtagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcacgaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggtatgtagatgaaaatatctatccaatttcagtttacttttgttttgttttttggttgattaattcgttggccagcttctggaatccttagttctctcttggtttaggctagattgtttgattgataatttttgcatgaatgttaatccctccttaattatcaacatctgtaattaatttggtatacactagggagttttgaatgaaggttgttgcttatgatttttggtaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgaggtaacatatagtccacattgccttaaatgttaattctgaaactatattttgtttggtgtcaatgtttaacggatttgtacatttgacagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataa

SEQ ID NO: 315 - DNA, 3121 bp, Arabidopsis thaliana; identical to SEQ ID NO: 314
  G217 DNA sequence used for BLAST

SEQ ID NO: 316 - DNA, 1385 bp, Arabidopsis thaliana
  G219 cDNA Sequence
aaaagaagcagaatcattcccatttataacaaacctaaacctctcttttcttcttctctttacctttttcattccaaaatctctctctctctctctctttctctggctcgggaagaagatgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcgtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttgatgaagaagataatgttttaattaatttatattgtataagataagatctggatgatgattaatttgaaatttgagaattaggctaattagatactttgatcagaatcaagtgagtttttaagtttgaattagtgtgtacatgtttttttgctctttttgggggaaacgacttgtcgtttttgttgttgtatgatgtaaaacaacaggtagtctctgtgttgttttggtcaagacttgatcagattcagaagtgaagacgacttcaagcttaagatagtttagatgtgtcttttgaaaagtttaaacagaatggttattgggttaaggttaagtgtatctcatatgctttttctatcttttttttggtaagacttttccagtaatttgccgttttcttcggggtgtgtgttgttgataatgtcacattcatgaaccaaacacagttatataactttagtaaaaaaaaaaaaaaaaaaaaaaaa

SEQ ID NO: 317 - protein, 261 aa, Arabidopsis thaliana
  G219 Amino Acid Sequence
MSRSCSQCGNNGHNSRTCPTDITTTGDNNDKGGGEKAIMLFGVRVTEASSSCFRKSVSMNNLSQFDQTPDPNPTDDGGYASDDVVHASGRNRERKRGTPWTEEEHRLFLTGLHKVGKGDWRGISRNFVKTRTPTQVASHAQKYFLRRTNQNRRRRRSSLFDITPDSFIGSSKEENQLQTPLELIRPVPIPIPIPPSRKMADLNLNKKKTPATTEMFPLSLNLQRPSSSTSSSSNEQKARGSRASSGFEAMSSNGDSIMGVA

SEQ ID NO: 318 - DNA, 962 bp, Arabidopsis thaliana
  G219 Genomic Sequence
atgtcacgtagttgctcacagtgtggaaacaacggccacaactctcgcacatgtccgacggacataactaccaccggtgacaacaacgacaaaggcggcggggagaaagccatcatgctttttggcgtccgcgtcacggaagcttcatcatcttgttttagaaaaagtgttagtatgaacaatctctctcaattcgatcaaactcctgatcccaacccaaccgatgacggtggttacgcttcagacgacgtcgttcacgcctccggtagaaaccgtgaacgcaaacgaggttaataaaataacctttcttctctctttcccaaatctcatctctgtttttgtttcttgtttttgaaactttcttgcaaatttggaatttaggaactccatggacagaggaagaacatagattgtttcttactggattgcataaagttggaaaaggtgattggagaggaatctctagaaactttgttaaaactcgaacacctactcaggtagcgagtcatgctcagaaatattttctccggcggactaatcagaatcgtcgtcgtcgtagatcaagcctcttcgatatcactcccgattcggtaacgtttcattctttaaaatctataattaaaatcaagaatctgtaagattatactaacacataaggttcgatatgtcaacagtttataggatcatcaaaagaagagaatcagttacagactccattggagctaatccgtccagttccgattcctattccgattccaccgtcgcggaagatggctgatttgaatcttaacaagaaaaaaactccagcgacaacggagatgtttccgctgtcgctgaatttgcagaggccgtcttcgtcgacatcgtcatcgtccaatgaacagaaggcacgtggctcacgtgcctcctcggggttcgaggcgatgtcgagtaatggagatagtataatgggagtggcttga

SEQ ID NO: 319 - DNA, 962 bp, Arabidopsis thaliana; identical to SEQ ID NO: 318
  G219 DNA sequence used for BLAST

SEQ ID NO: 320 - DNA, 1050 bp, Arabidopsis thaliana
  G220 cDNA Sequence
atgggaagatcaccgtgttgcgatcaagacaaaggcgtgaagaaaggaccgtggctgccagaagaagatgataagctcactgcttatataaacgagaatggttatgggaattggcggtcgcttcctaagctcgctggacttaaccgctgtggcaagagctgtcggctccggtggatgaattatctccggcctgatatccggagaggcaaattttccgatggagaagagagtactatcgttagactccatgccctccttggcaacaaatggtcgaaaattgcgggtcatcttccaggaagaacagataatgaaattaaaaactattggaacactcatatgaggaagaagttattgcaaatggggattgatccagtgacgcacgagccaagaaccaacgatcttagccctatcctcgatgtttctcaaatgctcgcggcagcaatcaacaatggccaatttggtaacaataacctcctcaacaataacaccgctttggaagatattcttaaactccaattgatccataaaatgcttcaaatcataacccccaaagccataccaaacatcagtagcttcaagaccaatttactgaatcctaaaccagaaccggtagtcaatagcttcaataccaattcagtgaatcctaaaccggatcccccggctggtcttttcataaaccaaagtggaatcactcctgaggccgcctcggatttcattccatcttatgaaaatgtttgggatggttttgaagataaccagcttcctggtttggttacggtttctcaagagagtttaaatacagcaaaaccgggtaccagtacgaccaccaaggtaaatgatcatatcagaaccggtatgatgccgtgttactatggtgatcaactactagaaaccccatctactggttcggtatcggtctctcccgagacaaccagtttgaaccatcccagtacagctcaacactcatccggttcagatttcctagaggactgggagaagtttcttgatgatgaaacaagtgattcttgctggaaaagtttcttagagtaa

SEQ ID NO: 321 - protein, 349 aa, Arabidopsis thaliana
  G220 Amino Acid Sequence
MGRSPCCDQDKGVKKGPWLPEEDDKLTAYINENGYGNWRSLPKLAGLNRCGKSCRLRWMNYLRPDIRRGKFSDGEESTIVRLHALLGNKWSKIAGHLPGRTDNEIKNYWNTHMRKKLLQMGIDPVTHEPRTNDLSPILDVSQMLAAAINNGQFGNNNLLNNNTALEDILKLQLIHKMLQIITPKAIPNISSFKTNLLNPKPEPVVNSFNTNSVNPKPDPPAGLFINQSGITPEAASDFIPSYENVWDGFEDNQLPGLVTVSQESLNTAKPGTSTTTKVNDHIRTGMMPCYYGDQLLETPSTGSVSVSPETTSLNHPSTAQHSSGSDFLEDWEKFLDDETSDSCWKSFLE

SEQ ID NO: 322 - DNA, 3110 bp, Arabidopsis thaliana
  G220 Genomic Sequence
ctatagtttgacactaaataagaagagtggtgaccaaatggaacctactactactagagtcgttaagggggcatttggttctccggcgatgatgggggtatgaagggttgatttctgaggaagtggtgctaaattttcaaaaaaaggagatataacacaagtgtctgcggagagataaagaatctcgtttttccttggataatacttgaaaagtctcttgtgattatcatagaagacaatatttccttgcttagaaaccgacaccggggtgaaccacctgttccgcctttcccgggaagcaactctattctctaaatctatggagtaagtcttggtccatgtttctacttctgtatccatgctccaaatctctagtttccattcagtcttagtataggtattggctatggccaggcggtcctcaaggttcactatttggaaggtttcttgcgtgacactcatatcaggaactgaaatgttatgtaactcttctttgtgaagatccaaggctagtattgtccaagccctctcagtaggtttgtgtaaccagtagatcgatccattcgcacactccgattttcttacctcaaagaccttataaggaggtggactcaacatccgccattcaccagtttcgacatcaagaacactatactccacctcaggatcacgtgcacaaatttcactgaaagatattaaacacatcttcactactttatagcttccggtaactttatctttaccaaatcccattgcccaatgtcttggagagaaagccgaacctactccaaatatggttccaaatccgaatccgtatcgccggagttgccttgtccaggggttcaaaacgtctatccaacgtggttcgagaatgcagaccaaaccgtcgcaagtaaacgagggttgtgcggcgttgcagtgcagatagacgatctcttcgttccctttgcactgcgacgacccggggaggagcctaggctcccagccgcatttgcagttgtaagcagccaggattttgcgcttcttttgaagactcattcgtctctccacgaacgtcttcgactcaagaattgatctccatcgttttgagacgcttttcgatatgagaatggatttcaagggaagtcgaaggaatatatcttctagaagatcggcaactatgtagatcgaactagggtttttctcttcttcctccattcttggtgactgtttgttttttgattttttgtcaatctttctgttagaaacatcgagagattgacattttaatatatttccttattggcaaataggtgaatttttattaaacttgtgaatcaagttatgtttccatagagttgtttgattgtataaattagactgctcgtagatatttatccaaaatattgttattaaatgggcaataatagaatggtgattacaatgtgtttctttacacaacaaccaaaccaaataagaacaaattacaaataagaattcctttacaagaaaatatacaaactttaaatcaatatttaataacaaacaaaattaagagtattaatcgaatatctttgtgtatgtattgtctttaaaactatgagtatacgacccgaacaaaatccagttctaccatgggacaggtgacgatgtgggtgacgttaagctgcagattagataaaacaattctgttaataaaccataaatataaatcatatactatgttaatcaatgcggagatagatcttactctaagaaacttttccagcaagaatcacttgtttcatcatcaagaaacttctcccagtcctctaggaaatctgaaccggatgagtgttgagctgtactgggatggttcaaactggttgtctcgggagagaccgataccgaaccagtagatggggtttctagtagttgatcaccatagtaacacggcatcataccggttctgatatgatcatttaccttggtggtcgtactggtacccggttttgctgtatttaaactctcttgagaaaccgtaaccaaaccaggaagctggttatcttcaaaaccatcccaaacattttcataagatggaatgaaatccgaggcggcctcaggagtgattccactttggtttatgaaaagaccagccgggggatccggtttaggattcactgaattggtattgaagctattgactaccggttctggtttaggattcagtaaattggtcttgaagctactgatgtttggtatggctttgggggttatgatttgaagcattttatggatcaattggagtttaagaatatcttccaaagcggtgttattgttgaggaggttattgttaccaaattggccattgttgattgctgccgcgagcatttgagaaacatcgaggatagggctaagatcgttggttcttggctcgtgcgtcactggatcaatccccatttgcaataacttcttcctcatatgagtgttccaatagtttttaatttcattatctgttcttcctggaagatgacccgcaattttcgaccatctgtatggtaaaaattcgactcaaacgttagtaaaatgaaccaacgaaaacttaaccttttgtatggttagagaattataaactaaagtttagactatagtcttgaggatgtgaattctataatagcaataataaactatgcaatggtatccatacgtaaatttgtttttgcactttatattaattttaaaagaactgaaaatggtttatattttaaaattatgaaaaaaacatgtaaacaggaacacataattacgtctgaaacaagcgagacctaaatcatttagtgctaacaaaatagcataaaagctttaacgaaaaaaaaatagtcttacttgttgccaaggagggcatggagtctaacgatagtactctcttctccatcggaaaatttgcctctccggatatcaggccggagataattcatccaccggagccgacagctcttgccacagcggttaagtccagcgagcttaggaagcgaccgccaattcccataaccattctcgtttatataagcagtgagcttatcatcttcttctggcagccacggtcctttcttcacgcctttgtcttgatcgcaacacggtgatcttcccat

SEQ ID NO: 323 - DNA, 3110 bp, Arabidopsis thaliana; identical to SEQ ID NO: 322
  G220 DNA sequence used for BLAST

SEQ ID NO: 324 - DNA, 1364 bp, Arabidopsis thaliana
  G222 cDNA Sequence
ctcattttataataattttctccatcttcttccttcctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatcttcagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacacggtgtttgatcagagcctttagattattaacatgtgttatagagagtttcattttctattcatattcatagacctgagtttattgattgatccatacatttgttatgcttgtgtgtaaagtatgtatatggtttttgatttatgtaaattttctgctcgagtgaatttttttggtgctaagatgtagttctttattccaaaaaaaaaaaa

SEQ ID NO: 325 - protein, 352 aa, Arabidopsis thaliana
  G222 Amino Acid Sequence
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIFSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNTVFDQSL

SEQ ID NO: 326 - DNA, 1319 bp, Arabidopsis thaliana
  G222 Genomic Sequence
atgggaagacattcttgttgttttaagcagaagctaagaaaaggcctttggtctcctgaagaagatgagaaacttctcaattacatcactagacatggtcatggctgttggagttctgtccctaaactcgcaggtttggtctctatgtgctcttatattatatatagcttaaagaggtttatatagcatcgtttataatgtttttatatgcgttggtggatatatatgatcaaataggtttgcaaagatgtggaaagagttgtagacttaggtggataaattatttgagaccagatttaaagagaggagctttctctcaagacgaagaaagcttgatcattgagctccatgctgcattaggcaacaggttcattaatttgcaacacatttatatagttttgaatttataatgtatattgtgtatatatatatatatgttaaaaaaaaaatctttggttcatattgaatatgtagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttagattattaacatgtgttatagagagtttcattttctattcatattcatag

SEQ ID NO: 327 - DNA, 1270 bp, Arabidopsis thaliana
  G222 DNA sequence used for BLAST
atgggaagacattcttgttgttttaagcagaagctaagaaaaggcctttggtctcctgaagaagatgagaaacttctcaattacatcactagacatggtcatggctgttggagttctgtccctaaactcgcaggtttggtctctatgtgctcttatattatatatagcttaaagaggtttatatagcatcgtttataatgtttttatatgcgttggtggatatatatgatcaaataggtttgcaaagatgtggaaagagttgtagacttaggtggataaattatttgagaccagatttaaagagaggagctttctctcaagacgaagaaagcttgatcattgagctccatgctgcattaggcaacaggttcattaatttgcaacacatttatatagttttgaatttataatgtatattgtgtatatatatatatatgttaaaaaaaaaatctttggttcatattgaatatgtagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttag

SEQ ID NO: 328 - DNA, 584 bp, Arabidopsis thaliana; identical to SEQ ID NO: 20
  G225 cDNA Sequence

SEQ ID NO: 329 - protein, 94 aa, Arabidopsis thaliana
  G225 Amino Acid Sequence
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 330 - DNA, 871 bp, Arabidopsis thaliana
  G225 Genomic Sequence
tcatttcctaaaaaagtctcttcgtctgttggcaaaaacgacgccgtgtttcataagccaatatctctctatctcctccggcgtccgtcccgggatccttccggcgatcaactcccacctacgcgccacgtaggataggctaacagtcagtgttgaggaacttacacttaaccaaataccttttattccgataaaaaccgcataaagtttgtaattcggttaaaattctatggaaccgaaccaaaatcgtaatttacactttgacttcatacaaacatgctgtaatcaaaattgaaccaaactagccaaagtgagttctgacataaattaagaatatgttttgctaaagaatcatatataaaaaaagaaactgaaaacgaaatcttgattaggttttgctatttgaacaactaaaacaaaaaacagagaataataacaagatcaaaaatcaggctgaacacagtcattgacagctcggtaagttagacccaataatataatagaaaaaccaagaaaatgcataaataaacgaccgactttgagatcaaaatctaagcagattcgacaaaacatgaaagaccaaaaaaaagagaaagcaacaagatggatcgagagagaaagagtctctaacctgtcgccaacgagtttatacatccgagaaatgagatcttcttcttcttctgacatcttcacagcttcccattcgatactactcacctctgcgaaacaaacatacaaaatcagactcaaaccgatcaaaaagatatagagagaaacaaagagaaatcagaccttcggaacaagaagccttggctttgctctgtctccgtcgtcgtttatccattttttccgccttgtctgaacgaaacat

SEQ ID NO: 331 - DNA, 871 bp, Arabidopsis thaliana; identical to SEQ ID NO: 330
  G225 DNA sequence used for BLAST

SEQ ID NO: 332 - DNA, 407 bp, Arabidopsis thaliana; identical to SEQ ID NO: 21
  G226 cDNA Sequence

SEQ ID NO: 333 - protein, 112 aa, Arabidopsis thaliana
  G226 Amino Acid Sequence
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 334 - DNA, 979 bp, Arabidopsis thaliana
  G226 Genomic Sequence
ttacaattttagattttcttggagattaagaggagaagtagaaaaaaagggagaattattaagacgtcgtcgtttgtgagaaaaatagtcagagtttctcataatccagtatctctcaatctcatttgcctttcttcctacgactcttcctgctattaaatcccacctgacaatcaatattcaagcatataatgtgtttttgaattatagacgagcacaaaattctgaaaaaacatttatcaaaattcaggagtcaacatatataatgcagaaatgaaatttaaaatgtatatatataaagacaataatattcaagagccaatatattattcaatcctttcactgtttttaaaatcatcacactttaagaaaagaagaaattttagtttctgttaattatacattttatcagtttatcaacaacataaaactttttttgaaattatacaagtaaaatactcatgtcattgcttaaatattggcatgtcatttttctcgaaacacgttcgaaagtctaaactactctagaatcatgtttaccataacataacactttatcagctttgatttgttactctcgccatgtgaattttttttaaattataaaatactagtttttttttttttttttttaattttataaaatactagttgtttttaaaatatgttgaatcggacatgacagaagaagagaatttgttacctattaccgacaagtctgtacattcgagagatgagatcttcttcttgttcggtcatactgataaactcccattcgatgctactcacttctgcatttttgtttcgttttatccaaacaaaaattaaatgagaagataatttaacgctgacgagttaggaggatgagtgtagagtaatgaattgaagagagaccttcagagtcatatcgggatcgagtgaacttagtttgcctaagactgggaccgcgacgaagacgaagacggttggtattatccat

SEQ ID NO: 335 - DNA, 979 bp, Arabidopsis thaliana; identical to SEQ ID NO: 334
  G226 DNA sequence used for BLAST

SEQ ID NO: 336 - DNA, 740 bp, Arabidopsis thaliana
  G228 cDNA Sequence
atggtgactgtaaaccctagccaagctcattgtttgcctatgaaaatgagtctaccgggtttcaatactcttccccacacggcaacaacgataccggtttccatacggagcaataggacgatgtcgttttttgaggatccaacaaagaaggttagaaagccttacactatcaccaaatctagagagaactggacggagcaagaacacgacaagttccttgaagcccttcatctgtatgttgacacggatttcacttctctgccttcatttatctgattaatgatatatagaatctttgagatttgttcttcttcttctgatatgatcatgtctatttgattgcagatttgaccgggattggaagaaaataaaggcctttgttggatcaaaaacagtgatacaggtaatcaatcaaacatatgcattccatacttttgtctgaagttacatataagtaattttatgaactctgttctttggggtggaattggagatataagttctatgtatgttggatagtaactagaatattggttttgtagatacgaagccacgcacagaagtactttctcaaagttcagaagaatgggactaaagaacatctcccacctcctcgaccaaagaggaaagccaatcacccatatccacaaaaagctcctaaatgtggcaaccttaaaccttttatctttctacttccgcttttgttactttatctcattttctcatggttatgtttttga

SEQ ID NO: 337 - protein, 162 aa, Arabidopsis thaliana
  G228 Amino Acid Sequence
MVTVNPSQAHCLPMKMSLPGFNTLPHTATTIPVSIRSNRTMSFFEDPTKKVRKPYTITKSRENWTEQEHDKFLEALHLFDRDWKKIKAFVGSKTVIQIRSHAQKYFLKVQKNGTKEHLPPPRPKRKANHPYPQKAPKCGNLKPFIFLLPLLLLYLIFSWLCF

SEQ ID NO: 338 - DNA, 740 bp, Arabidopsis thaliana
  G228 Genomic Sequence
tcaaaaacataaccatgagaaaatgagataaagtaacaaaagcggaagtagaaagataaaaggtttaaggttgccacatttaggagctttttgtggatatgggtgattggctttcctctttggtcgaggaggtgggagatgttctttagtcccattcttctgaactttgagaaagtacttctgtgcgtggcttcgtatctacaaaaccaatattctagttactatccaacatacatagaacttatatctccaattccaccccaaagaacagagttcataaaattacttatatgtaacttcagacaaaagtatggaatgcatatgtttgattgattacctgtatcactgtttttgatccaacaaaggcctttattttcttccaatcccggtcaaatctgcaatcaaatagacatgatcatatcagaagaagaagaacaaatctcaaagattctatatatcattaatcagataaatgaaggcagagaagtgaaatccgtgtcaacatacagatgaagggcttcaaggaacttgtcgtgttcttgctccgtccagttctctctagatttggtgatagtgtaaggctttctaaccttctttgttggatcctcaaaaaacgacatcgtcctattgctccgtatggaaaccggtatcgttgttgccgtgtggggaagagtattgaaacccggtagactcattttcataggcaaacaatgagcttggctagggtttacagtcaccat

SEQ ID NO: 339 - DNA, 740 bp, Arabidopsis thaliana; identical to SEQ ID NO: 336
  G228 DNA sequence used for BLAST

SEQ ID NO: 340 - DNA, 1209 bp, Arabidopsis thaliana; identical to SEQ ID NO: 36
  G229 cDNA Sequence

SEQ ID NO: 341 - protein, 371 aa, Arabidopsis thaliana
  G229 Amino Acid Sequence
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMANASSAPPPPQAKRRLGRTSRSAMKPKIRRTKTRKTKKTSAPPEPNADVAGADKEALMVESSGAEAELGRPCDYYGDDCNKNLMSINGDNGVLTFDDDIIDLLLDESDPGHLYTNTTCGGGGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 342 - DNA, 2805 bp, Arabidopsis thaliana
  G229 Genomic Sequence
tcatgacagaagccaagcgaccaaagcgctttcgtcgtcatgatctaacggttctccaaagttctcacaattactattcccgatcgtggcctcatcatcaccgtctaaaagccacgagaccattgagtcgggattctctttctcatgccaaagattattatcactaccttcttgccaaacacaatcccaatcgataaactcatccgtcgacgcatcgttaacttggtggtcgtagttgagaaacgactccaccgatggacaagactgaagaagacagtcgagattcccttggttccaagtatccgagaaccctctggctccttcagagtctcttatgttatgcaactccccatcaccaccgcacgttgtgtttgtgtacaagtggccaggatctgactcgtccaacaaaagatcgatgatatcatcatcaaacgttaaaactccattatcgccattaatgctcatgagatttttgttacaatcatctccatagtagtcacatggtcgtcctagctcagcctcggctccacttgactccaccattaatgcttctttatcagccccagctacatcggcgttaggctccggtggtgcagacgttttcttcgttttacgagtttttgttctgtggatttttggtttcatagcggacctactcgttctcccaagtctgcgttttgcctgcggcggcggtggcgctgaagaagcgttcgtcatgattacggcggagacgtcttgagagatggatggcttcctaatgaagttgtggagtttacggctgagatgagagttccaataattttttatttcgttgtctgttctccctggtagatgacccgcgattagtgaccacctacatgcattgcattaatcaataattaatcctctgttcattgcattatattaatcctctattcacaatttggaacaaccttgataaaattaaatatctttccggggaataagagaacctcgtggcccaatgagaatcaatagaatagtgttctaaatttgatttgccatgttgatatgactgctgacctaatcatgacatcgctcgagcaatgtcagtaatgagtgacgatgactaattcgtactactctcgttgagttccttgtccgatttccaatattggatttattttagcggacactactatgaatcacatatacttgtttaacgttgagtaataataattaaaattttaaataaacagatcctcgctttttttttctcatgtttactagtttttcatgttgaaaacttgcaatacatatgtgactgtattttgtttgaagtgttgttgtacagatgcacatgtgttatatcaactgtgttcctattaatgcttatgtaatatacgaagtgtaaaaaaaatgaggtacaatttagtttgtctcaactaaaagagaaaaagtctaacaccccaatggttaagaggaagacccacaacgaaataactatttctcattcgacgataaaatagtatttttattttaccatttcgactttaaattaaattttccaaccataaaaatgtgcttcgctaaagtttatagtatttaagagagagaataatcgtaattaagccgtcttataataccgaatctccacttacttggtcgacatgatatcattattatacgatacagtgcataaaaacaaattgaacgaatataaatgggaaaaaatgaaaaacataataaataaaatagagtttggaaaataaagtaaaataatagagtacctgtttcccaaagtggaatgcaatttaacaacgagttcttcttcttctggagttatgtttccacgcttgaggtctgatcttagatagtttatccatctcaatctacagctctttccacacctttttaatccttttccaaaaaacaaataaaaacaattaacaatataataatacacttcatatttagatgcagattcatacgtcaaaatatatgtttatgcagattttgttagataaattttgataaagttttcaggtatttattaatttaactagggtctgatgtgtgactgctcacgagattcttagctttttgatcattgtatttattcatatatcttatgcatataatatatatcacaactacaaaaaattctcaactactacattaagtaaccttctattaaaagcgaggttagaaatcaaatcaaaactagtcatatggttttgatctgattcttgaaatgatatacaacggacaaaaatacataaatacgcttctgtttgtatttccttttaaacatttgtccatatactataagtctataacataacctaccctcttaaagcatgcacttggcagcattttacatatatctacattaaacaacccaccgtgactgtgattcgcacgaaaaaagaaaaacccaaaaactgaaataaattggaaacaaagattagggttgcagttaaacttctaaccttcctaaaaatttaatttattttttaaaaaacttactaacaatccttaattcttttatcaaaagcaaaaaaaaaaaactgactaagaatccatgtttcatgaagattacgacaagaaccacgattatttctctatgtcttattctctcatatatacattgttatagattaaattaagtttgtgttgcatgatcttgttaataaaagtgtaaatgttattaccggcatttttggggagagatctccaagaaccttcaccgttggattgaatgtagttggagagaatctggtcctcctccgccgtccaccgccctctcttgataccgaccttctcgcaacatggcgctcttcccat

SEQ ID NO: 343 - DNA, 2805 bp, Arabidopsis thaliana; identical to SEQ ID NO: 342
  G229 DNA sequence used for BLAST

SEQ ID NO: 344 - DNA, 916 bp, Arabidopsis thaliana; identical to SEQ ID NO: 74
  G231 cDNA Sequence

SEQ ID NO: 345 - protein, 266 aa, Arabidopsis thaliana
  G231 Amino Acid Sequence
MGRQPCCDKLGVKKGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 346 - DNA, 1292 bp, Arabidopsis thaliana
  G231 Genomic Sequence
atggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctgacttaaaacgaggccttctctcgcatgatgaagaacaacttgtcatagatcttcatgctaatctcggcaataagtaagcctaataatcatatattaattccacattttttttgaattcttacttaatgatttgtgtcatataatatcaacggaggcttaaaattttcaaatttatattaaaaattcaaattttacgttgtaacaaaaactagagacttaagataaacattggtttgatcatcataaaatataaagtcaattgcatgtgatccaacatgtttagtgtattaatgtgtgttgtgtaaattatgccaaatggttccaaataagttggtcaaataagtagaataagttttgatttgcattgatttttcgttgaaatcaacttcaagctacttcaagacaaagtaacgtccttctcttccagagataatgttaacttattttgtcaatcttcttgtttttctataccaagattgtaacatatatatccaccaacactttataaaatattatttattcttgtaattaatttgttatttaaaaccattggttgtattataggtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttga

SEQ ID NO: 347 - DNA, 1292 bp, Arabidopsis thaliana
  G231 DNA sequence used for BLAST
tcaaaacccaaaatcatgaacaccaaagtcttgacaataatccaaaaacatcttctcgtcattgattctttccggtgaccatatcggaaaatctgcatcggcgccggagatattgtggtcatataatgttccaccaacaccaaagttactatcactccaagaggcctcatctttagtagtttcgtcggaccataagtaactaaacaattcatcatcatcataaatgttgtcaattagatgattttcattatccatcgaactgttttgatcagtaaccgtgctactactttcttcttctgttgtcgtgacacttatctccacgtatttcgtgttagttgtctttggttccactgagacatcgtctggattggacggaatggttttggaattatcgatattagaaggttcttgatttaggggttgatgggtcataggatcgattcccatcttaagaagtttcttcttgatatgagtattccaatggttttttatttcgttatctgttcttccaggtaatcttgaagctatcttagaccacctataatacaaccaatggttttaaataacaaattaattacaagaataaataatattttataaagtgttggtggatatatatgttacaatcttggtatagaaaaacaagaagattgacaaaataagttaacattatctctggaagagaaggacgttactttgtcttgaagtagcttgaagttgatttcaacgaaaaatcaatgcaaatcaaaacttattctacttatttgaccaacttatttggaaccatttggcataatttacacaacacacattaatacactaaacatgttggatcacatgcaattgactttatattttatgatgatcaaaccaatgtttatcttaagtctctagtttttgttacaacgtaaaatttgaatttttaatataaatttgaaaattttaagcctccgttgatattatatgacacaaatcattaagtaagaattcaaaaaaaatgtggaattaatatatgattattaggcttacttattgccgagattagcatgaagatctatgacaagttgttcttcatcatgcgagagaaggcctcgttttaagtcaggccggagatagttagtccaccggaggcggcagctctttccacagcgacggagaccggccagcttcggcaaagcacgccagcaacaatggccattggttagtatgaagtttataagcttcttatcttcctccaccgtccacggccctttcttcacccctagcttgtcacagcatggctgtctccccat

SEQ ID NO: 348 - DNA, 1256 bp, Arabidopsis thaliana
  G232 cDNA Sequence
aaaaaaagaattacaattaataagaacaagatcaagaatcaagaatcaagaaaatgggaagagcaccgtgttgtgataaggccaacgtgaagaaagggccttggtctcctgaggaagacgccaaactcaaagattacatcgagaatagtggcacaggaggcaactggattgctttgcctcagaaaattggtttaaggagatgtgggaagagttgcaggctaaggtggctcaactatttgagaccaaacatcaaacatggtggcttctccgaggaagaagacaacatcatttgtaacctctatgttactattggtagcaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacaacaacatagtgaatcttgagaccatcgagaacacaaaagtctatggagacgcctcagtagccggagccgctgtccgagcagctttggccggagggacaacgagtacatcggcggatcaaagtacaataagttgggaggatataacttctctagttaattccgaagatgcaagttacttcaatgcgccaaatcatgtgtaacattttgtttaaaactttatttgtacttacatacataaagaggggttttctattttgtaaaaaaaaaaaaaa

SEQ ID NO: 349 - protein, 376 aa, Arabidopsis thaliana
  G232 Amino Acid Sequence
MGRAPCCDKANVKKGPWSPEEDAKLKDYIENSGTGGNWIALPQKIGLRRCGKSCRLRWLNYLRPNIKHGGFSEEEDNIICNLYVTIGSRWSIIAAQLPGRTDNDIKNYWNTRLKKKLLNKQRKEFQEARMKQEMVMMKRQQQGQGQGQSNGSTDLYLNNMFGSSPWPLLPQLPPPHHQIPLGMMEPTSCNYYQTTPSCNLEQKPLITLKNMVKIEEEQERTNPDHHHQDSVTNPFDFSFSQLLLDPNYYLGSGGGGEGDFAIMSSSTNSPLPNTSSDQHPSQQQEILQWFGSSNFQTEAINDMFINNNNNNNIVNLETIENTKVYGDASVAGAAVRAALAGGTTSTSADQSTISWEDITSLVNSEDASYFNAPNHV

SEQ ID NO: 350 - DNA, 1951 bp, Arabidopsis thaliana
  G232 Genomic Sequence
ccataaagtcactttttgattcaattttattttaattccctatactttattgacatcttccatcacatgaaggactatctcctccagctattatatactctctctctctctcctttattttttctcaattcacatataattttcacctttacacacatttccatgtaagtatatataaacctcacacacgcattatcatacaccatcctcctcattctcttcatcatcaacataagagagagagaagaaaaaaagaattacaattaataagaacaagatcaagaatcaagaatcaagaaaatgggaagagcaccgtgttgtgataaggccaacgtgaagaaagggccttggtctcctgaggaagacgccaaactcaaagattacatcgagaatagtggcacaggaggcaactggattgctttgcctcagaaaattggtatgtattacttaaaactcacttttgatttaaaattggcactgagagtttccaaatagtactttgagaccgtggtcgtgttaaatttgtgtgttgatgatatttatttacatggtataggtttaaggagatgtgggaagagttgcaggctaaggtggctcaactatttgagaccaaacatcaaacatggtggcttctccgaggaagaagacaacatcatttgtaacctctatgttactattggtagcaggtactatatacttacatatatatcatcatatgcatggatgaatattattaattgacacacttattcttgacttagagactcactatgtatctttgtttaattctaggtggtctataattgctgcacaattgccgggaagaaccgacaacgatatcaaaaactattggaacacgaggctgaagaagaagcttctgaacaaacaaaggaaagagttccaagaagcgcgaatgaagcaagagatggtgatgatgaaaaggcaacaacaaggacaaggacaaggtcaaagtaatggtagtacggatctttatcttaacaacatgtttggatcatcaccatggccattactaccacaacttcctcctccacatcatcaaatacctcttggaatgatggaaccaacaagctgtaactactaccaaacgacaccgtcttgtaacctagaacaaaagccattgatcacactcaagaacatggtcaagattgaagaagaacaggaaaggacaaaccctgatcatcatcatcaagattctgtcacaaacccttttgatttctctttctctcagcttttgttagatcccaattactatctgggatcaggagggggaggagaaggagattttgctatcatgagcagcagcacaaactcaccattaccaaacacaagtagtgatcaacatccaagtcaacagcaagagattcttcaatggtttgggagcagtaactttcagacagaagcaatcaacgatatgttcataaacaacaacaacaacatagtgaatcttgagaccatcgagaacacaaaagtctatggagacgcctcagtagccggagccgctgtccgagcagctttgggcggagggacaacgagtacatcggcggatcaaagtacaataagttgggaggatataacttctctagttaattccgaagatgcaagttacttcaatgcgccaaatcatgtgtaacattttgtttaaaactttatttgtacttaaatacataaagaggggttttctattttgtataaatctgtgtctttagggagtggtagaaaagttttatggattgagattagtattcatgcagaaatttgtttattttagtttcaacttagctttattcgaacaacttatatgatattttttcgagtttttccttcattgttcttgcttttataaatgtgaagagattctatcattctaccttttagcttcttcttttgtcccttaattaattaggtctttatatattttataatctttgca

SEQ ID NO: 351 - DNA, 1351 bp, Arabidopsis thaliana
  G232 DNA sequence used for BLAST
ttacacatgatttggcgcattgaagtaacttgcatcttcggaattaactagagaagttatatcctcccaacttattgtactttgatccgccgatgtactcgttgtccctccgcccaaagctgctcggacagcggctccggctactgaggcgtctccatagacttttgtgttctcgatggtctcaagattcactatgttgttgttgttgtttatgaacatatcgttgattgcttctgtctgaaagttactgctcccaaaccattgaagaatctcttgctgttgacttggatgttgatcactacttgtgtttggtaatggtgagtttgtgctgctgctcatgatagcaaaatctccttctcctccccctcctgatcccagatagtaattgggatctaacaaaagctgagagaaagagaaatcaaaagggtttgtgacagaatcttgatgatgatgatcagggtttgtcctttcctgttcttcttcaatcttgaccatgttcttgagtgtgatcaatggcttttgttctaggttacaagacggtgtcgtttggtagtagttacagcttgttggttccatcattccaagaggtatttgatgatgtggaggaggaagttgtggtagtaatggccatggtgatgatccaaacatgttgttaagataaagatccgtactaccattactttgaccttgtccttgtccttgttgttgccttttcatcatcaccatctcttgcttcattcgcgcttcttggaactctttcctttgtttgttcagaagcttcttcttcagcctcgtgttccaatagtttttgatatcgttgtcggttcttcccggcaattgtgcagcaattatagaccacctagaattaaacaaagatacatagtgagtctctaagtcaagaataagtgtgtcaattaataatattcatccatgcatatgatgatatatatgtaagtatatagtacctgctaccaatagtaacatagaggttacaaatgatgttgtcttcttcctcggagaagccaccatgtttgatgtttggtctcaaatagttgagccaccttagcctgcaactcttcccacatctccttaaacctataccatgtaaataaatatcatcaacacacaaatttaacacgaccacggtctcaaagtactatttggaaactctcagtgccaattttaaatcaaaagtgagttttaagtaatacataccaattttctgaggcaaagcaatccagttgcctcctgtgccactattctcgatgtaatctttgagtttggcgtcttcctcaggagaccaaggccctttcttcacgttggccttatcacaacacggtgctcttcccat

SEQ ID NO: 352 - DNA, 1046 bp, Arabidopsis thaliana; identical to SEQ ID NO: 37
  G233 cDNA Sequence

SEQ ID NO: 353 - protein, 273 aa, Arabidopsis thaliana
  G233 Amino Acid Sequence
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 354 - DNA, 1095 bp, Arabidopsis thaliana
  G233 Genomic Sequence
tgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcacatataagtatataaccgacacacaagttttattttgttttcttactatatataaatcaccaaaagaaagtaactttatacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctag

SEQ ID NO: 355 - DNA, 1095 bp, Arabidopsis thaliana; identical to SEQ ID NO: 354
  G233 DNA sequence used for BLAST

SEQ ID NO: 356 - DNA, 1139 bp, Arabidopsis thaliana; identical to SEQ ID NO: 92
  G234 cDNA Sequence

SEQ ID NO: 357 - protein, 309 aa, Arabidopsis thaliana
  G234 Amino Acid Sequence
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 358 - DNA, 1160 bp, Arabidopsis thaliana
  G234 Genomic Sequence
atgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtattaataaatttatagtcactctttttcatataaatttgataattctctcttgatctatctctttttttgtgaagaagtattgataactaaagatgctttttgtttatatgattatttcttggttgttttaaggtttaaagagatgtggaaagagttgcaggctgaggtggcttaactatcttagaccaaacatcaaacatggtggcttctctgaggaagaagaaaacatcatttgtagcctttaccttacaattggtagcaggtactattcatatacgttattcatgtatatatcgttaaaatatcatgtggaaactctgaaatatagttatgtgatgatgtctataattaaaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcatgaatcaaaccaactcgttttgcgaccaagaagatgttaagccagtgctcatcaagaacatggtcaagatcgaagatcaagaactggagaaaacaaaccctcatcatcatcaagattcaatgacaaacgcttttgatcatctctctttctctcaactcttgttagatcctaatcataaccacttaggatcaggcgagggtttctccatgaactctatcttgagcgccaacacaaactctccattgcttaatacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaa

SEQ ID NO: 359 - DNA, 1160 bp, Arabidopsis thaliana; identical to SEQ ID NO: 358
  G234 DNA sequence used for BLAST

SEQ ID NO: 360 - DNA, 920 bp, Arabidopsis thaliana; identical to SEQ ID NO: 7
  G237 cDNA Sequence

SEQ ID NO: 361 - protein, 283 aa, Arabidopsis thaliana
  G237 Amino Acid Sequence
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 362 - DNA, 1019 bp, Arabidopsis thaliana
  G237 Genomic Sequence
ttacgtcgttgttgatggagaaaagaattcagcagaagaattacaatctgaagcctctctataaatatgatgctcctgcttcttacatttggaaccaaacacaatgtcgttaagagtccagttgctgttgttgatcatcatttcgttgtaatggaactgatcaacatcacccatttcttcataagctgagagagtctcttcgacatttggagcttgactgtgcttagagtcggtaaactcagaggaataatcggtgtggggatatgaagaagaaagccattcagagaagaaaagccttggaatctcaggagcagaagaacattgatggctgttatttccgttgctttcttgtgagggagatgaagatttgttctctagaagtctctggaaggagaacacgtgattcgagatcaaggtttccggatttctttttccacaagcaacaagtgatgatgatgaagacgaaggaggggaaatagattttgcatcttgtaagctctgagacttgagccatttctttttcaaatgagagtgccaatagttctttatctcattgtctgttcttcccggtaagaatttagctatttgcgaccacctaattacacctaaatcattagtctctctataactagcatctgctaaaacaatagggttaggtcttagagatacacttacttgttacccaaggaagaatgaaacgtcaagatagtctcttcttcttctgcactaatcatatccctctttaaccctggtcttaggtaattaatccatcttaatctgcagctcttcccattcctttgtaaccctatcaaattaaatcccaacaacaattatcaaagttgactcagtttgagaaactaaaaactaataaagaagaagatgaaagagagaccagctttgatgggaacagtggtccagcaagaatggccataagagaggatgaagctccttagcttctcgtcttcttcaggtgaccataaccctttcctatgtctctctccatatttcgtcttcgccat

SEQ ID NO: 363 - DNA, 1019 bp, Arabidopsis thaliana; identical to SEQ ID NO: 362
  G237 DNA sequence used for BLAST

SEQ ID NO: 364 - DNA, 1347 bp, Arabidopsis thaliana
  G239 cDNA Sequence
atggaagattacgagcgaataaactcaaactctccaacacatgaagaagattctgatgtacggaaaggtccatggaccgaggaagaagatgcaatcctagtcaacttcgtctctattcatggcgatgctcgttggaaccacatcgctcgttcctctgggctaaagcgaactggtaagagttgtagattaagatggcttaattacttacgtccagatgttagaagaggcaacatcactctcgaagaacaatttatgatcctcaaactccattctctttggggcaataggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaaggaaatatacgattactatacgtaacgaggaattcaattgcgtcacgtttggtgtaatattcattcgtgcgtgatgccaattttagatacggccttggtatacgaatctttgacttaattattatcttttcttttcctctcttgttttaaacccctgattaaattaagatttgatcatcagacgaggatatttgtgattcactgatttgtgatattgatatatgtgaattatttgatataacgttttaaaaaccaacaaaaaaaaaaaatcattccaaggaaaagttcttaattttgatactcgaaaagagcgtagactgactcgaatcagttcatattttctttggttcgttttatttacgacaaaattcactaacaaaaattaaaaaacgacaaaacgaaaatatgactaaatttatttttttgtcagttaaccactgattataggttgaaattgtcacaacacatgatttatcttgatagaaatttagtagtccagaatgctgcatggttgatcctaagaaa

SEQ ID NO: 365 - protein, 273 aa, Arabidopsis thaliana
  G239 Amino Acid Sequence
MEDYERINSNSPTHEEDSDVRKGPWTEEEDAILVNFVSIHGDARWNHIARSSGLKRTGKSCRLRWLNYLRPDVRRGNITLEEQFMILKLHSLWGNRWSKIAQYLPGRTDNEIKNYWRTRVQKQAKHLRCDVNSNLFKETMRNVWMPRLVERINAQSLPTTCEQVESMITDPSQPVNEPSPVEPGFVQFSQNHHQQFVPATELSATSSNSPAETFSDVRGGVVNGSGYDPSGQTGFGEFNDWGCVGGDNMWTDEESFWFLQDQFCPDTTSYSYN

SEQ ID NO: 366 - DNA, 1014 bp, Arabidopsis thaliana
  G239 Genomic Sequence
atggaagattacgagcgaataaactcaaactctccaacacatgaagaagattctgatgtacggaaaggtccatggaccgaggaagaagatgcaatcctagtcaacttcgtctctattcatggcgatgctcgttggaaccacatcgctcgttcctctggtatcatcaaaacatcaatctctaaatatacatatacacaaaggctttatatatagataaacttatatatattttactcatatatgtgcagggctaaagcgaactggtaagagttgtagattaagatggcttaattacttacgtccagatgttagaagaggcaacatcactctcgaagaacaatttatgatcctcaaactccattctctttggggcaataggtacacactatatatctcaaatgttaatattttgctattctatatgttactagttaagtatgttattaatatatgtcttttttttcaattgaatatataaggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataattaa

SEQ ID NO: 367 - DNA, 1010 bp, Arabidopsis thaliana
  G239 DNA sequence used for BLAST
atggaagattacgagcgaataaactcaaactctccaacacatgaagaagattctgatgtacggaaaggtccatggaccgaggaagaagatgcaatcctagtcaacttcgtctctatccatggcgatgctcgttggaaccacatcgctcgttcctctggtatcatcaaaacatcaatctctaaatatacatatacacaaaggctttatatatagataaacttatatatattttactcatatatgtgcagggctaaagcgaactggtaagagttgtagattaagatggcttaattacttacgtccagatgttagaagaggcaacatcactctcgaagaacaatttatgatcctcaaactccattctctttggggcaataggtacacactatatatctcaaatgttaatattttgctattctatatgttactagttaagtatgttattaatatatgtcttttttttcaattgaatatataaggtggtcgaagattgcgcaatatctaccgggaagaacagataatgaaataaagaattattggagaactcgagtccaaaagcaagccaaacacctaagatgcgatgttaacagtaatcttttcaaggagactatgagaaatgtttggatgccgagattagtggaacgaatcaacgcccaatcattacccaccacgtgtgaacaagtggagtcaatgatcaccgacccaagtcaaccagttaacgaaccgagtccggtcgagccgggtttcgttcaattcagccagaatcatcatcagcaattcgtaccggctacggaattgtcagcaacgtcttcgaattctccggctgagacgttttcggacgttcgaggtggggtggtgaacgggtcaggttatgatccgtcgggtcaaacgggtttcggagagttcaacgattggggctgtgttggtggggacaacatgtggactgacgaggagagtttttggttcttgcaggaccagttctgccccgatacgacatcgtattcgtataa

SEQ ID NO: 368 - DNA, 1046 bp, Arabidopsis thaliana; identical to SEQ ID NO: 37
  G241 cDNA Sequence

SEQ ID NO: 369 - protein, 273 aa, Arabidopsis thaliana; identical to SEQ ID NO: 353
  G241 Amino Acid Sequence

SEQ ID NO: 370 - DNA, 646 bp, Arabidopsis thaliana
  G241 Genomic Sequence
atgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcaacatataagtatataaccgacacacaagttttattttgttttcttactatatataaatcaccaaaagaaagtaactttattacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagatttatcaaccagctaa

SEQ ID NO: 371 - DNA, 646 bp, Arabidopsis thaliana; identical to SEQ ID NO: 370
  G241 DNA sequence used for BLAST

SEQ ID NO: 372 - DNA, 1195 bp, Arabidopsis thaliana
  G242 cDNA Sequence
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 373 - protein, 305 aa, Arabidopsis thaliana
  G242 Amino Acid Sequence
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 374 - DNA, 914 bp, Arabidopsis thaliana
  G242 Genomic Sequence
tggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgag

SEQ ID NO: 375 - DNA, 915 bp, Arabidopsis thaliana
  G242 DNA sequence used for BLAST
atggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgag

SEQ ID NO: 376 - DNA, 1080 bp, Arabidopsis thaliana
  G245 cDNA Sequence
atgggaaaatcttcaagctcggaggaaagtgaagtgaagaaagggccatggactccggaggaagacgagaagctcgtaggctatattcaaacgcacggtcccggcaaatggcgtacccttcccaagaacgccgggttaaaaagatgcgggaagagttgtagattgcgatggacgaattatctaagacccgatatcaagagaggagagttctctcttcaagaggaagaaaccatcattcaacttcatcgtcttcttggaaacgaatggtccgcaattgctattcacttaccaggaagaacagataatgaaatcaaagactattggaacacacatattaaaaagaaactcttacgaatggggattgatccggtgactcattgtccccgcattaatcttctccagctctcttcgtttcttacctcatcattgtttaaatctatgtcacaaccgatgaatactccatttgatctcactacttcaaatattaatcctgatatcttgaatcatctcactgcctctctcaacaacgttcagaccgaatcataccaaccaaaccaacagcttcaaaacgacctaaacactgaccaaaccactttcaccggtttgctcaactcaacaccacccgttcaatggcaaaacaatggagaatacttgggagattatcacagttataccggtacaggtgatccatctaataacaaagtccctcaagccggaaactactcatcagccgcatttgtatccgaccacattaatgatggtgagaattttaaggccggatggaatttcagttcatcaatgctagcgggaacttcatcgagcagctcgacaccgttgaattcgtcttcgactttttatgtcaatggtggaagcgaagatgatagagagagttttggtagcgacatgttgatgtttcatcatcatcatgatcataataataatgctttgaatctatcataatgtcttatttattttgcttcttgatcttatttgttttatttttacttttttttaatgggggtttgtaattgtgttacatactttgtaatataagagcttagtctattattatgttgactc

SEQ ID NO: 377 - protein, 319 aa, Arabidopsis thaliana
  G245 Amino Acid Sequence
MGKSSSSEESEVKKGPWTPEEDEKLVGYIQTHGPGKWRTLPKNAGLKRCGKSCRLRWTNYLRPDIKRGEFSLQEEETIIQLHRLLGNEWSAIAIHLPGRTDNEIKDYWNTHIKKKLLRMGIDPVTHCPRINLLQLSSFLTSSLFKSMSQPMNTPFDLTTSNINPDILNHLTASLNNVQTESYQPNQQLQNDLNTDQTTFTGLLNSTPPVQWQNNGEYLGDYHSYTGTGDPSNNKVPQAGNYSSAAFVSDHINDGENFKAGWNFSSSMLAGTSSSSSTPLNSSSTFYVNGGSEDDRESFGSDMLMFHHHHDHNNNALNLS

SEQ ID NO: 378 - DNA, 1486 bp, Arabidopsis thaliana
  G245 Genomic Sequence
tgatagattcaaagcattattattatgatcatgatgatgatgaaacatcaacatgtcgctaccaaaactctctctatcatcttcgcttccaccattgacataaaaagtcgaagacgaattcaacggtgtcgagctgctcgatgaagttcccgctagcattgatgaactgaaattccatccggccttaaaattctcaccatcattaatgtggtcggatacaaatgcggctgatgagtagtttccggcttgagggactttgttattagatggatcacctgtaccggtataactgtgataatctcccaagtattctccattgttttgccattgaacgggtggtgttgagttgagcaaaccggtgaaagtggtttggtcagtgtttaggtcgttttgaagctgttggtttggttggtatgattcggtctgaacgttgttgagagaggcagtgagatgattcaagatatcaggattaatatttgaagtagtgagatcaaatggagtattcatcggttgtgacatagatttaaacaatgatgaggtaagaaacgaagagagctggagaagattaatgcggggacaatgagtcaccggatcaatccccattcgtaagagtttctttttaatatgtgtgttccaatagtttttgatttcattatctgttcttcctggtaagtgaatagcaattgcggaccatctatagaagaaaaaatatcgtgttatagattttaagttaaaatcaaaaagagaagtataagttttaacttgttaagatattagctgcagcgagttgaagattgcatgcttagctttagacatttgaccttggtatagtgcttaactatgttcttgtcttttagttgaataaaataaaatatgcaagtaatattataacaaaaatgtaaagacatggaagtccaatgaagtaggtgtagtagtggaaaactaggtcattttttacttaatttaatcatacatgtaaacaattatacactaaatgaagaaatgaaaaattgcagatagactaacttgtttccaagaagacgatgaagttgaatgatggtttcttcctcttgaagagagaactctcctctcttgatatcgggtcttagataattcgtccatcgcaatctacaactcttcccgcatctttttaacccttttaagattcacaccaagaaaaacgaataagaaccatgattgttttaattttaattctaacgttgacatgatctagcatgataatcattattagtaaattttaaacataaacgtaaaacaaaacgcaggaaaacatattgtagctgataggatttagctatttgtatatatacatgcgttagggtaggaatttaccggcgttcttgggaagggtacgccatttgccgggaccgtgcgtttgaatatagcctacgagcttctcgtcttcctccggagtccatggccctttcttcacttcactttcctccgagcttgaagattttcccat

SEQ ID NO: 379 - DNA, 1486 bp, Arabidopsis thaliana; identical to SEQ ID NO: 378
  G245 DNA sequence used for BLAST

SEQ ID NO: 380 - DNA, 731 bp, Arabidopsis thaliana
  G249 cDNA Sequence
ccgccgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 381 - protein, 214 aa, Arabidopsis thaliana
  G249 Amino Acid Sequence
MEKRESSGGSGSGDAEVRKGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESGSIMMPLSVDQSEQNYWSVDDLWPMNIYNGN

SEQ ID NO: 382 - DNA, 2241 bp, Arabidopsis thaliana
  G249 Genomic Sequence
attaccattatatatattcatgggccaaagatcatcgacgctccaatagttttgttcggattgatcaacagataatggcatcatgatcgaaccggattcaggcacataattaccataattaagctgctgattaatattgctggcatgttgatacgacgtcgttggagaatacatatccatggtttcttgagtatcattcatgacatggctcgttgtcgcatgatggtttataaactcggagctttgtgatccaacggtcgtcgtttctccgctcttgatgatgtatttctggatcttagtcctccaaaaattctttatctcattgtcggttcttcctggtaaatgctttgcaatttttgaccacctaatcataatgaaggataatcatcacgagttgataaactatatcactttttgtttgaaaaaaaatatattatgtttttgaaggttcgatctagttgttgatgcaatgaaacagctacatctacgtcgagcaataaaaaaaggtttgcattgagactttgtaagctttggttgtagaacaacatttgccaaatgcttcgattttgtaattagttagaatccctttcgaattccataaagaagttaacattcatattaaaaaaaagaagctattattaaatacatgtgtggtttaaaaaaatttaagagccaagacccgaaagatccgtaaataaatcaaataatattcaacttcaatccaaatttcagttacaccaccatatggaatatctaactttcggtatctatcacttttatgcgtatacatttgtgttgacaaaaaacagatgtatattttggtacttgtctttgtatatggtcgtgtaaaagaattacaatcatgcacaagttgtggtagaatcggcacgaggttttttaatgttagtggtgagggaatttcgaaacgtgtttaaaactcaaacaaatggctgaaaagagttgaaaagctttgttatacccaccaatatgtttggcttcattacctaatgtcttgctttgatgtcttttcaaagatcaattctatctttagcctcaagaatatatatataaccgatgcatagtttgaaaacttagctttgcttctcttgttaaacatataacctgactatcttaaaattttatgtgtatttaggtaatcactaacctatttccccattttgcatgaagttccatgatggtgagctgttcttctggtgtgatatttccccgtcgcacatcaggtcggaggtagttcagccaccggagccggcaacttttcccggtgcgttttagtcctatattacacatataataatatataattacaattacaatcgataatgaagaaacaaaatatcaattgtgtacatgtctattaacaaaataaataaaaaaatgtgtacacgtcgataacaataaagaaaaaaacatttatgtgtgcatgcatgtattatttattggtgaaagaaataatttttttttttcattttctattattgtgtttttagctattaattaaaaacctaaaatcagtttttagtggattgccgtaacaattctaaccagagagtattaagtgttttacattgaatagttcaccggataaacttgtttatgttagatcgagagtaagctttttaaaaccctagcgattgctgtcagtatatattactaattgcttgtgggtattctgatgaacaagaccttttgtaagctatatgttccaatcaatcaaacaatcaattaaggtccgggcattaaaaaataaattcttatcggtttaccttatatatgtgtaagaatttggagatagtcttgcttccattgtttttcttgtttttcatatgaaattaaaattcctaactcatatttagatcgcttgtgtaacaaaaagctcaaaatagagagtttctatcaaacccataaaagattaatatatataaaaaaaaaaactggaaacatatagtgattaaaatataatatcttcgcatgtgaagaacaaaccctagttcatcaacacatacacacatataagcataacaaatattggagatcaattataactttttgatatatatatataagagtttgacctgcagatttggcgagagagttccaaacaccttcaccatgattggcgatataattgatgagaatcaaatcttcttccatcgtccatggcccttttctcacctctgcatctcctgatccagacccaccactactttctcttttctccat

SEQ ID NO: 383 - DNA, 2241 bp, Arabidopsis thaliana; identical to SEQ ID NO: 382
  G249 DNA sequence used for BLAST

SEQ ID NO: 384 - DNA, 1024 bp, Arabidopsis thaliana
  G251 cDNA Sequence
acccacgcgtccggagaagtaaaattttctattgcagagagaaagagagttagagaaagagagagagagatgaaacttgtgcaagaagaataccgtaaaggaccgtggacagaacaggaggacatcctcttggtcaactttgtccacttgttcggagatcgaagatgggattttgtagcgaaagtttcaggtttaaacagaacaggaaagagttgcaggttaaggtgggttaattacctgcatcctggtctcaaacgtggtaagatgactccacaagaagagcgtttagtccttgagcttcacgccaaatggggaaacaggtggtcaaaaattgcccggaaattaccggggagaacagataatgagataaagaactactggaggactcatatgaggaagaaggctcaagagaagaagcgacctatgtctcctacttcctcatcttcaaactgttgctcatcatctatgaccactactactactcaagacactggaggctccaacgggaaaatgaatcaagaaggcgaagacgggtactactccatggatgacatatggagagagattgatcagtctggacacgttattaaaccggtaaaagacaactactactcagagcaaagttgttacttgaatttccctcctctggcttctccaacatgggaaagttccttggagtctatatggaacatggatgcagatgaaagtaagatgtcttcttttgctattgatcagtttcctctaagttttgaacatggtagtggtcgcctttagtctaggatttgattcatttggaatgtttatatgtgcagcatatatatgttatcaaacgacgactgtagtagtttcctatgacttacatcaaaaaacaccacccactgtactaatctcataagtagtcatcatcctatgcctttgtttagtttgtagagtgagtgaaaagatgtgtaatacaagtcagaactctaattccaaaataaatagacttttgaagcttctgtgaaaaaaaaaaaaaaaaaaaaaa

SEQ ID NO: 385 - protein, 234 aa, Arabidopsis thaliana
  G251 Amino Acid Sequence
MKLVQEEYRKGPWTEQEDILLVNFVHLFGDRRWDFVAKVSGLNRTGKSCRLRWVNYLHPGLKRGKMTPQEERLVLELHAKWGNRWSKIARKLPGRTDNEIKNYWRTHMRKKAQEKKRPMSPTSSSSNCCSSSMTTTTTQDTGGSNGKMNQEGEDGYYSMDDIWREIDQSGHVIKPVKDNYYSEQSCYLNFPPLASPTWESSLESIWNMDADESKMSSFAIDQFPLSFEHGSGRL

SEQ ID NO: 386 - DNA, 923 bp, Arabidopsis thaliana
  G251 Genomic Sequence
atgaaacttgtgcaagaagaataccgtaaaggaccgtggacagaacaggaggacatcctcttggtcaactttgtccacttgttcggagatcgaagatgggattttgtagcgaaagtttcaggtttgaaggtggagggagaaacataagaataggtataggtttgttttggaaaaatgggcggtctttggaaaggaccttccatttaaagaaatgacctggttttggttgtaggtttaaacagaacaggaaagagttgcaggttaaggtgggttaattacctgcatcctggtctcaaacgtggtaagatgactccacaagaagagcgtttagtccttgagcttcacgccaaatggggaaacaggtcagaagaatcttcaagaaacagagaaaccctaaaaatgtttttttttttaaccctaaaaatgttctttgtttgttgtttgagcttttggatactttcatatgcaggtggtcaaaaattgcccggaaattaccggggagaacagataatgagataaagaactactggaggactcatatgaggaagaaggctcaagagaagaagcgacctatgtctcctacttcctcatcttcaaactgttgctcatcatctatgaccactactactagtcaagacactggaggctccaacgggaaaatgaatcaagaatgcgaagacgggtactactccatggatgacatatggagagagattgatcagtctggagcaaacgttattaaaccggtaaaagacaactactactcagagcaaagctgttacttgaatttccctcctctggcttctccaacatgggaaagttccttggaatctatatggaacatggatgcagatgaaagtaagatgtcttcttttgctattgatcagtttcctctaagttttgaacatggtagtggtcgcctt

SEQ ID NO: 387 - DNA, 923 bp, Arabidopsis thaliana; identical to SEQ ID NO: 386
  G251 DNA sequence used for BLAST

SEQ ID NO: 388 - DNA, 1086 bp, Arabidopsis thaliana
  G252 cDNA Sequence
acaacgacaagatcaagaaaagacaaagatttgtaagaaaatgggaagagctccatgctgcgacaaggcaaacgtgaagaaaggaccatggtcaccggaagaagatgtgaagctcaaggattacatcgacaaatatggcactggtggcaactggatcgcactgcctcagaaaattgggctgaagagatgtggtaagagttgcagactgagatggcttaattacttaagaccaaacatcaaacatggtggtttttcggaggaagaagatagaatcatcttgagtctctacattagcattggaagccggtggtccataattgcagctcagcttcctggaaggactgacaatgatatcaagaattattggaacacaaaactgaagaagaaacttctaggaagacagaaacaaatgaatcgtcaagactccataaccgattctactgagaacaacctcagcaacaataacaacaataagagtcctcagaatctgagcaattcggcactggagaggctccagcttcacatgcagcttcagaatctacagagccctttctctagtttctacaacaaccctatcttgtggcccaagcttcatccattgctccagagcactacaactaatcaaaaccctaagcttgcatctcaagaaagcttccaccctttaggagttaacgttgatcatcagcacaacaataccaagctagctcagataaacaatggagcctcttctcactattcggagaacgtagagcaatcccaaaaccctgctcatgaatttcaacctaatttcggttttccacaggaccttcgattagataatcataacatggactttatgaacagaggggtttctaaagaactgtttcaagtgggcaacgagtttgagctaacgaacggttcgagttggtggtcagaggaagtggaactagagaggaaaacgacgtcgtcgagttcttgggggtcagcttctgtgcttgatcagacaactgagggaatggttatgcttcaagattacgctcagatgagctaccacagtgtttaataagttatatcatgcatatatataaatgcgtaactatagggatg

SEQ ID NO: 389 - protein, 333 aa, Arabidopsis thaliana
  G252 Amino Acid Sequence
MGRAPCCDKANVKKGPWSPEEDVKLKDYIDKYGTGGNWIALPQKIGLKRCGKSCRLRWLNYLRPNIKHGGFSEEEDRIILSLYISIGSRWSIIAAQLPGRTDNDIKNYWNTKLKKKLLGRQKQMNRQDSITDSTENNLSNNNNNKSPQNLSNSALERLQLHMQLQNLQSPFSSFYNNPILWPKLHPLLQSTTTNQNPKLASQESFHPLGVNVDHQHNNTKLAQINNGASSHYSENVEQSQNPAHEFQPNFGFPQDLRLDNHNMDFMNRGVSKELFQVGNEFELTNGSSWWSEEVELERKTTSSSSWGSASVLDQTTEGMVMLQDYAQMSYHSV

SEQ ID NO: 390 - DNA, 1482 bp, Arabidopsis thaliana
  G252 Genomic Sequence
atgggaagagctccatgctgcgacaaggcaaacgtgaagaaaggaccatggtcaccggaagaagatgtgaagctcaaggattacatcgacaaatatggcactggtggcaactggatcgcactgcctcagaaaattggtaagaattctgaaatgtttaaattctaatcccaaaagtaatcgcttataattttcaatttcgattgattagatcaagttttgttctgactttgagatttgtgtaaattatagggctgaagagatgtggtaagagttgcagactgagatggcttaattacttaagaccaaacatcaaacatggtggtttttctgaggaagaagatagaatcatcttgagtctctacattagcattggaagccggtcggtgatctatctctcttgatttctattaataataagttaattaacacctcttcattaaatatataaatttttttgttatgatttagaggtaatttctgttgaaatttcgacttgagattcttgtctttttaccttttgtctatgaatcttatgctgaaacacatgcaagcccatgtttcttcaagctatggtatctcacatagaatttagggtttatattgtctctttcttcttgttttggtgtctttgtaagaacctttatacatttatatcttttaatcttgaacttggttcgtgattctaaatacatagttttctaaaaaaaactttctattagttttaaccttaatgtgatatatttatgcaggtggtccataattgcagctcagcttcctggaaggactgacaatgatatcaagaattattggaacacaaaactgaagaagaaacttctaggaagacagaaacaaatgaatcgtcaagactccataaccgattctactgagaacaacctcagcaacaataacaacaataagagtcctcagaatctgagcaattcggcactggagaggctccagcttcacatgcagcttcagaatctacagagccctttctctagtttctacaacaaccctatcttgtggcccaagcttcatccattgctccagagcactacaactaatcaaaaccctaagcttgcatctcaagaaagcttccaccctttaggagttaacgttgatcatcagcacaacaataccaagctagctcagataaacaatggagcctcttctctctattcggagaacgtagagcaatcccaaaaccctgctcatgaatttcaacctaatttcggtttttcacaggaccttcgattagataatcataacatggactttatgaacagaggggtttctaaagaactgtttcaagtgggcaacgagtttgagctaacgaacggttcgagttggtggtcagaggaagtggaactagagaggaaaacgacgtcgtcgagttcttgggggtcagcttctgtgcttgatcagacaactgagggaatggttatgcttcaagattacgctcagatgagctaccacagtgtt

SEQ ID NO: 391 - DNA, 1482 bp, Arabidopsis thaliana; identical to SEQ ID NO: 390
  G252 DNA sequence used for BLAST

SEQ ID NO: 392 - DNA, 1391 bp, Arabidopsis thaliana; identical to SEQ ID NO: 64
  G254 cDNA Sequence

SEQ ID NO: 393 - protein, 302 aa, Arabidopsis thaliana
  G254 Amino Acid Sequence
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPLPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 394 - DNA, 1425 bp, Arabidopsis thaliana
  G254 Genomic Sequence
ctacttacttgctctgcaaactcgggacttgtcagatttacagacaggttttgcatcagtaaaagaacctgatgtatcaaaaagaaacaatatcaaagaagcttctttattatcatcaggattgaatttttcaacaaaggctcagagtagggactgagtctgattaaacgtgtctcataccgtttccatatttattggatccatctgctttaatctctggaggtggcctgatgtgttgggatcgaagacacttccaatgaagctgtaaacttcagcaaaattcggcatcactgcattaaaacagctccattgtcagcgtaaatctcaaagatgtctactagaaaaacacataatgtaacaagataacaagtcttacctctatgtggcttttcacaactttcttcgttatttggctttgtcactgctcgtaccctctctgtatcttcctgtctgcagcgattatttgggagaggagccgtggccgagactcccggttcctctactatcacaaattcattacaccccattgttaacacgattcacaaatacaactaactcaaaatctcatcaactgaaagcataaccactagtaaaacctaccttcaatcaccggttttggcagatttgtcgattcatgattccacgaagaagaggtagatgcacaaacagcctggtttcccatcaatgacttcgaatcagagctatacaaataaccaggctcaagcaacggtaatgtactcgaagacgggagagaggtataagcaactgcagcagcataacaaatcattagaaaatgattaaagcaaagaagaaaacagagtaagaagatgatcaaaagtcaccatttttaggagcctttataggataaggatgactcgctttcctcttaggtcgaggaggtggaagatgttcgttagcaccactcttctgaactttgagaaagtatttctgagcgtggcttcgtatctgccattattactcttaaacatcatcaacacacaatcattttcaaaaacaatacagagaataatagtaagatggtcttcaaattaaacctgaactactgtttttgatccaacaaaggcttctattttcttccaatccctatcgaatctgtaatcaaacgaaaacaatcaaatctcgaaacttgtgaaattttcttaaacgaaacacacaattgagtgacaattacacgtacaagtgaagagcttctagaaatttatcgtgctcttgatctgtccaattctctctcgacttcttgattgtgtacggcttccgaatcttcgtcgtcggatcctcagaaaacgacaccgtactggtccgtcccgtggccggaatcgaaccaaatccatcggagcttggtaaactcatattcgaggaatcgaaaactggaaaacccttaggtctagggtttacggacaccat

SEQ ID NO: 395 - DNA, 1425 bp, Arabidopsis thaliana; identical to SEQ ID NO: 394
  G254 DNA sequence used for BLAST

SEQ ID NO: 396 - DNA, 1547 bp, Arabidopsis thaliana; identical to SEQ ID NO: 22
  G256 cDNA Sequence

SEQ ID NO: 397 - protein, 332 aa, Arabidopsis thaliana
  G256 Amino Acid Sequence
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 398 - DNA, 1520 bp, Arabidopsis thaliana
  G256 Genomic Sequence
gtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtctttatatatcttcattcactctccttctttcttcttcttatatatctttcttataagctttttccacatatataaatatttatatatgtttcaggtttgctaaggtgtagcaagagttgcagacttagatggactaattaccttcgtcccgggatcaaacgaggaaatttcactcaaccggaagagaagatgatcatccaccttcaagctcttttgggaaataggtatggaattactcctttaattctccctgttttatattaaattgattcacgttgatctccaatatctaagtttgtccatcttcgtaatctcctaattaacaatataaattatatagagtattagcatttcattttattagtgtttttttttgttattatttatttgattggatgtccactttgaaaataagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaagtact

SEQ ID NO: 399 - DNA, 1281 bp, Arabidopsis thaliana
  G256 DNA sequence used for BLAST
atgggtagaccaccttgttgcgagaagattgaggtgaagaaaggaccatggactcccgaagaagacataatcttggtctcttatatccaacaacacggccctggaaattggagatctgtccctgcaaacaccggtctttatatatcttcattcactctccttctttcttcttcttatatatctttcttataagatttttccacatatataaatatttatatatgtttcaggtttgctaaggtgtagcaagagttgcagacttagatggactaattaccttcgtcccgggatcaaacgaggaaatttcactcaaccggaagagaagatgatcatccaccttcaagctcttttgggaaataggtatggaattactcctttaattctccctgttttatattaaattgattcacgttgatctccaatatctaagtttgtccatcttccgtaatctcctaattaacaatataaattatatagagtattagcatttcattttattagtgttttttttgttattatttatttgattggatgtccactttgaaaataagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactgatgatcaaggctcgttgtcattgatcgagaaatggttgtttgatgatcaaggcttggttcagtgtgatgatagtcaagaagatctcatcgacgtgtctttagaggagttaaaataa

SEQ ID NO: 400 - DNA, 1160 bp, Arabidopsis thaliana
  G260 cDNA Sequence
ctgtatatatgagaaaaaaaacaagttaaagagtgcttttgatccaaaatgttaaacatgagcaaaaatgaaggttcattaacctcagtatcatatttcatcaccacaacgtatgatatggtcgatgatctttcattagattcaataatttcttggagccagagcggcaagagtttcatcatttggaatccagaagaattttacaacaatcttcttcaaagattctgcttccaacgcataaatacctttttctctttccttttttcacatggtttcagaaaaatcgactctggaaaatgggaattcgcgaatgataattttgtgcgaggtcaacgtcacctcataaataacattataagtgatgtaatagagcaggaggttcaatatgatcaaggaatggaattgtttaaagcagaaaaattatttgcacgactagtgaaaaaagtacaggatcaattgccacctcataacagttatccaacctcaaaacttcctttccccaccaaaatctatgagatggtggacgatccttcatcggatgctattatctcatggagccaaagtggcaagagtttcatcatttggaatccacaagaattttgcaaagatcatcttcgtagactcttcaataccctccatatacattttttcttctataaacttaaaatatttggtttcaaaaaaattaatccaaagaaatgggaatttgcaaatgataattttgtccggggtcaacgtcaccttgtggaaatcattataagcaatgataaaaagaagaatgatcaactacgtaaacaggatgccagagagaaaaaaatggcggaggcaggagaattgtttaagttgcaaattgaggaaatgtcggatatgagaaagaaaatgaagaaggccaaggaagtaaaggaacaagaggttcgactctgcaaattatgagtttgttggaggtcaatcttattttatgaataatatccataagaagctctagcttgtcattaccattaaagtttgtatttattagttttctttgagattatgtttaatgtttttgtttgtgcaacagttgcttctttggctttctgctttctgtaaaatcccttaaaaaggatgtaataattattctttgatttggcatagtactcgttataagtctcttgtaaaaa

SEQ ID NO: 401 - protein, 294 aa, Arabidopsis thaliana
  G260 Amino Acid Sequence
MLNMSKNEGSLTSVSYFITTTYDMVDDLSLDSIISWSQSGKSFIIWNPEEFYNNLLQRFCFQRINTFFSFLFSHGFRKIDSGKWEFANDNFVRGQRHLINNIISDVIEQEVQYDQGMELFKAEKLFARLVKKVQDQLPPHNSYPTSKLPFPTKIYEMVDDPSSDAIISWSQSGKSFIIWNPQEFCKDHLRRLFNTLHIHFFFYKLKIFGFKKINPKKWEFANDNFVRGQRHLVEIIISNDKKKNDQLRKQDAREKKMAEAGELFKLQIEEMSDMRKKMKKAKEVKEQEVRLCKL

SEQ ID NO: 402 - DNA, 1068 bp, Arabidopsis thaliana
  G260 DNA sequence used for BLAST
atgttaaacatgagcaaaaatgaaggttcattaacctcagtatcatatttcatcaccacaacgtatgatatggtcgatgatctttcattagattcaataatttcttggagccagagcggcaagagtttcatcatttggaatccagaagaattttacaacaatcttcttcaaagattctgcttccaacgcataaatacctttttctctttccttttttcacatgtaagttacttatatatgattactttagtaagatgtcatcatagatagttttgtattctctcaactttgaatcttccttttcgttagggtttcagaaaaatcgactctggaaaatgggaattcgcgaatgataattttgtgcgaggtcaacgtcacctcataaataacattataagtgatgtaatagagcaggaggttcaatatgatcaaggaatggaattgtttaaagcagaaaaattatttgcacgactagtgaaaaaagtacaggatcaattgccacctcataacagttatccaacctcaaaacttcctttccccaccaaaatctatgagatggtggacgatccttcatcggatgctattatctcatggagccaaagtggcaagagtttcatcatttggaatccacaagaattttgcaaagatcatcttcgtagactcttcaataccctccatatacattttttcttctataaacttaaaatatttgtaagtttcttatatgttagttttgtaagatgtaatcatattcttttagctagtttttgttttgcttattaactttgaatcttcttttttctatagggtttcaaaaaaattaatccaaagaaatgggaatttgcaaatgataattttgtccggggtcaacgtcaccttgtggaaatcattataagcaatgataaaaagaagaatgatcaactacgtaaacaggatgccagagagaaaaaaatggcggaggcaggagaattgtttaagttgcaaattgaggaaatgtcggatatgagaaagaaaatgaagaaggccaaggaagtaaaggaacaagaggttcgactctgcaaattatga

SEQ ID NO: 403 - DNA, 1857 bp, Arabidopsis thaliana; identical to SEQ ID NO: 4
  G261 cDNA Sequence

SEQ ID NO: 404 - protein, 401 aa, Arabidopsis thaliana
  G261 Amino Acid Sequence
MDENNHGVSSSSLPPFLTKTYEMVDDSSSDSIVSWSQSNKSFIVWNPPEFSRDLLPRFFKHNNFSSFIRQLNTYGFRKADPEQWEFANDDFVRGQPHLMKNIHRRKPVHSHSLPNLQAQLNPLTDSERVRMNNQIERLTKEKEGLLEELHKQDEEREVFEMQVKELKERLQHMEKRQKTMVSFVSQVLEKPGLALNLSPCVPETNERKRRFPRIEFFPDEPMLEENKTCVVVREEGSTSPSSHTREHQVEQLESSIAIWENLVSDSCESMLQSRSMMTLDVDESSTFPESPPLSCIQLSVDSRLKSPPSPRIIDMNCEPDGSKEQNTVAAPPPPPVAGANDGFWQQFFSENPGSTEQREVQLERKDDKDKAGVRTEKCWWNSRNVNAITEQLGHLTSSERS

SEQ ID NO: 405 - DNA, 1283 bp, Arabidopsis thaliana
  G261 DNA sequence used for BLAST
tcaacttctctctgaagaagtcagatgtccaagctgttctgtaattgcattaacatttctcgaattccaccaacatttctcagtacgtactccggctttatctttatcgtctttcctctctaattgaacttcccgttgctcggttgagccaggattctctgagaaaaactgctgccagaagccatcattcgctcctgctactggaggaggaggaggagcagcaacagtgttctgttctttcgaaccatcgggctcacagttcatatcgatgatccttggagaaggaggagatttgagacgtgaatcgacacttaactgtatgcaagaaagaggagggctctctggaaaagtagatgattcatccacatcaagtgtcatcatacttcttgattgtaacatactctcacaagaatccgatacaagattctcccaaatcgctatcgatgactctaactgttccacttgatgctctcttgtgtgtgaagaagggcttgtagaaccttcctctctcacaacaacacaagttttgttctcttccaacatcggttcatcgggaaagaactcgatcctagggaaccttcttttcctctcgtttgtttcgggaacacacggcgataggttcaaagcaagccctggcttttccaatacttgagaaacaaacgaaaccattgttttctgacgcttctccatgtgttgtaatcgttctttaagttctttcacttgcatctcaaacacttctcgttcctcgtcttgtttatgtaactcttcaagcaatccttctttctcttttgtcaatctctcaatctgattattcattctcactcgttctgaatccgtcaacgggtttaactgagcttgaagattcggtaaagagtggctatgaactggtttgcgtctatgaatgttcttcataagatgaggttgacctctcacaaaatcatcattcgcaaattcccattgctcaggatcagcttttctaaaaccctacacacaaaaacaaattccactaagaagatgattgatttagtcaatacttttaaacaaagcatgaaaacacttacatatgtgttaagctggcggataaagctagagaagttattgtgcttgaagaatctcggaagaagatctctagaaaactccggcggattccaaacgatgaaactcttattgctctgactccaagagacgatagaatcggatgaagaatcatcaaccatctcatatgttttggtgaggaaaggtggaagtgagcttgatgaaactccatgattattctcatccat

SEQ ID NO: 406 - protein, 495 aa, Arabidopsis thaliana
  G262 Amino Acid Sequence
MFVNFKYFSFFIRTKMDGVTGGGTNIGEAVTAPPPRNPHPATLLNANSLPPPFLSKTYDMVEDPATDAIVSWSPTNNSFIVWDPPEFSRDLLPKYFKHNNFSSFVRQLNTYGFRKVDPDRWEFANEGFLRGQKHLLKKISRRKSVQGHGSSSSNPQSQQLSQGQGSMAALSSCVEVGKFGLEEEVEQLKRDKNVLMQELVKLRQQQQTTDNKLQVLVKHLQVMEQRQQQIMSFLAKAVQNPTFLSQFIQKQTDSNMHVTEANKKRRLREDSTAATESNSHSHSLEASDGQIVKYQPLRNDSMMWNMMKTDDKYPFLDGFSSPNQVSGVTLQEVLPITSGQSQAYASVPSGQPLSYLPSTSTSLPDTIMPETSQIPQLTRESINDFPTENFMDTEKNVPEAFISPSPFLDGGSVPIQLEGIPEDPEIDELMSNFEFLEEYMPESPVFGDATTLENNNNNNNNNNNNNNNNNNNNTNGRHMDKLIEELGLLTSETEH

SEQ ID NO: 407 - DNA, 1635 bp, Arabidopsis thaliana
  G262 DNA sequence used for BLAST
ctagtgttctgtttctgatgtgagaagacccaattcttctataagcttatccatatgtctaccatttgtgttgttgttgttgttgttgttgttgttgttgttgttgttgttgttgttgttgttgttgttctctagtgtagttgcatctccaaaaactgggctttctggcatatattcttcaaggaattcaaagttactcattagttcatcaatctcggggtcttcgggtattccctcaagctgaatcgggactgaaccaccatcaaggaatgggcttggagagatgaatgcctctggaacattcttctctgtatccatgaagttttctgtagggaagtcgttgatactctctcgtgtcaattgtggtatctgggaagtctctggcattatggtatccgggagagaagttgaagtagagggtaagtatgataaaggctgtcctgatggtacagatgcatatgcctgtgactgtcctgaagttatgggtagtacctcttgaagagtgactcctgatacctggtttggagatgagaacccgtcaagaaacggatacttatcatctgttttcatcatgttccacatcattgaatcgtttctaagtggctgatacttaactatctgtccatctgatgcttccaagctatggctatgactattactctcagtagcagcagtactatcctctctgagtctccgcttcttattggcctcggttacatgcatattactatcagtctgcttctgtataaactgagagaggaaagtaggattctgtacagctttagcaaggaaagacataatctgttgttgcctctgctccataacctgaagatgtttaaccaaaacctgaagtttattatctgttgtttgttgctgctggcgtaacttaacgagttcctgcatcaacacgtttttgtctcttttaagctgttcaacttcttcctctaacccaaatttcccaacctcaacacatgaagataatgcagccattgaaccttgaccctgagataattgctgagattgtggattactactactactaccatgtccctgaacagattttctccggcttatcttcttcaatagatgtttttgacctcttaagaaaccttcattagcaaattcccatcgatctggatccactttcctaaaaccctgttcatcaaaattggcacatgaatcatataaatcttatcaaacacatcaagcactaagattattcaacgaaatcataatctatacacagtacaattagagaaatcaatggtggagaaattagggcgcgagagaatttatacttacataggtgtttaactggcgaacaaagctggagaaattgttgtgtttgaagtatttaggtagaagatcacgagaaaactccggtggatcccaaacaatgaagctattgttcgtcggactccatgagacaatcgcgtccgtcgccggatcttccaccatgtcatacgtcttgctaaggaaagggggcggtaaagagttcgcattaagtaaagtcgctggatgcggattccgcggtggtggcgccgtcacagcctcgccgatattcgttcctccgccggtaacaccgtccattttcgtacggataaagaaagagaagtatttgaaatttacaaacat

SEQ ID NO: 408 - DNA, 1121 bp, Arabidopsis thaliana; identical to SEQ ID NO: 65
  G263 cDNA Sequence

SEQ ID NO: 409 - protein, 284 aa, Arabidopsis thaliana
  G263 Amino Acid Sequence
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 410 - DNA, 1047 bp, Arabidopsis thaliana
  G263 Genomic Sequence
ttagttgcagactttgctgcttttccacaacggcgcgtgaaagtccacgttctttatttccgtcatacgggacccactcaccacataattcttttcatcccggtccctcttttttctctctcctttcaaccacaccccaaacaatttcaatccttcacctaccccctcctctgctcctccgccgccgtcgcaaccttcgcactcactctcttcgtcagactccaccggtttaaatttccctcctttgatcattttatcgatttgttccggtcttactttcagatgacccgtcaagaacgtcactagctcatcgcgctgcttcttcgccgccgcgagctccgagctcaagttattgttttcacgtttaagcttctcgttctctcctgataaatcagcaaccatgttctccaccgaaccaggattcttcgacgaaccgggtgatgacgtggagcttgaaccgtgatcatcaccaccaccagaattagactcagaaggcgaaccaacaacaacacatttccccgccgttgaagcaatcaccgatttacgccgtcgtatgtccgtcaacagatcctccccgcctctccggaaataatcgtttgcaaattcccatttatccggtacagttttacgaaatccctaaaccaaaaaaaaaaaaaaaaaaagaacaagaacattctcagcttctagaaggttttctcaccaacccccaaattatgagaaaattacgaaattggctaaccaactacaaaagaatgattcaattcaccaaacgaattaaatgaagcattaaattgagagtaaatgagttttcgttagagtgaaactcacgtaagtgttgagctgacgaatgaagcttgagaaattattatgcttgaagtattgaggaagaagatctttagcaaactctgctgttttccacacgacaaaagctgttccttcttcgttccatgaaacgacgtcgtctgtgctatgatcatcaactagctgatacgttttgcttaaaaacggcgccggaactgatctttgcgccgccgtcacagccgtcat

SEQ ID NO: 411 - DNA, 1047 bp, Arabidopsis thaliana; identical to SEQ ID NO: 410
  G263 DNA sequence used for BLAST

SEQ ID NO: 412 - DNA, 1392 bp, Arabidopsis thaliana
  G271 cDNA Sequence
cccacgcgtccgcttaaggcaagaacttttctataaaatagatcttgactttcttcttctcctatctaagttcaattcatttgatattccttctaaaaatggggcaacaacaatcacagtccaaggatgagatgctgtttcaagaagtgagtaacaacaacgtcgaaggtatcaaatcacttcaccatgaaggagcaggactcgagggggtggataaattagggagaacaccattaatcttagcttgtacgaacgacgatctatatgatgtagcaaaaactctgcttgagttgggctccaatgtcaatgcttatcgttctggttgcaatggtgggactcctctgcaccatgctgcaaaaagaggtctcgtacacacggttaagttacttctgtctcacggtgcaaatccattggttcttgatgatgatgttaagacagctctcgaggttgctagagatgaaggttacagtaatgtcgtacgcgcaatcgagagtcatatctgcttgttctctggttgtatgcgtgagtattctggctccagcttgcttaatttatttgctcctcagcttctttcaagaaaagtatgggtagttgtcgtaccaactggttcaagaaaccctacaaagcctttaaagttggagttggttctgtatgatagtattcaggatgcacaaccaagaatggtgatacctttgtggaaagcaaacttagaggaaccaaaatcatttcggtgtgatgattcagtgatgattattgatgactccagaagtccaaagtccatgaggcagagaagagaaagcggattcatttctcaggcgaggcgttgggctcaagtcgatagagaaatacgtcttaagctagcagctgagatcaaaggcgacatgaaacagatgaattggttttctgaggcatgtaaaggagttccacagccaatgaatcctccaaggtttatgaaaacatctcaagcaacaacaacaacaaccaatgttcctgcactaagtgatgatgctttgactcgtgtcgccatgtcacttccttctccaaaaactgcgaataaagaagatggactgtgtgtgatttgtgtggatgcaccatctgaagcagtgtgtgtgccgtgtggacatgtcgccggatgcatttcttgcttgaaagagattgaaaacaagaaaatgggatgtcctgtttgtcgcgccaacattgatcaggtcattaagctatatcatgtttgaagcatatctcctctatggctggaagatattgaaactatctcctattttttactttgtctttaaaagataactacaaatttttttattgtgtgtatgttatgtggtgaagtcaaagaagtcgaaatatagaatcacgacaagtttagtttgtctttttatcaaa

SEQ ID NO: 413 - protein, 376 aa, Arabidopsis thaliana
  G271 Amino Acid Sequence
MGQQQSQSKDEMLFQEVSNNNVEGIKSLHHEGAGLEGVDKLGRTPLILACTNDDLYDVAKTLLELGSNVNAYRSGCNGGTPLHHAAKRGLVHTVKLLLSHGANPLVLDDDVKTALEVARDEGYSNVVRAIESHICLFSGCMREYSGSSLLNLFAPQLLSRKVWVVVVPTGSRNPTKPLKLELVLYDSIQDAQPRMVIPLWKANLEEPKSFRCDDSVMIIDDSRSPKSMRQRRESGFISQARRWAQVDREIRLKLAAEIKGDMKQMNWFSEACKGVPQPMNPPRFMKTSQATTTTTNVPALSDDALTRVAMSLPSPKTANKEDGLCVICVDAPSEAVCVPCGHVAGCISCLKEIENKKMGCPVCRANIDQVIKLYHV

SEQ ID NO: 414 - DNA, 1726 bp, Arabidopsis thaliana
  G271 DNA sequence used for BLAST
ctgtataaatttccaattagtattaaaggttaaaatgagacaaagagacacatatatcacgaaagttaattgtatatatcttatggcatatacctgtggaactcctttacatgcctcagaaaaccaattcatctgtttcatgtcgcctttgatctcagctgctagcttaagacgtatttctggaaaaaaacaaaagaaactcatgtttttaattcacgagacataacaatttgtatggttactgaatcttaaaaaataataaagagttacttacgtctatcgacttgagcccaacgcctcgcctgagaaatgaatccgctttctcttctctgcctcatggactttggacctatccatgataataaagttcaatcaacaaggaacaaacagattctttataaaatgcatgaaaagtgtgaggaattacttctggagtcatcaataatcatcactgaatcatcacaccgaaatgattttggttcctctaagtttgctttccacaaaggtatcaccattcttggttgtgcatcctagtggtaaacatctcaaaacttagaaacaatgacactatccaacaagattcccaaaccagtgaactagataatgaaaaattcctcaagagactaaaggataatttttaagtacctgaatactatcatacagaaccaactccaactttaaaggctttgtagggtttcttgaaccagttggtacgacaactacccatctgcaaaacatgttccaaaaaagattcatattcatgtgtgcgctacaagaaagtaattaggtgctaaagattgaaaaaattggttaaatggtaaatactcacacttttcttgaaagaagctgaggagcaaataaattaagcaagctggagccagaatactcacgcatacaaccagagaacaagcagatatgactctacaagaatcaacagtctaaaagttataaaaagctcatgactcgtctaattgcagtcaatatgaaataagtgttacaagcatatacctcgattgcgcgtacgacattactgtaaccttcatctctagcaacctcgagagctgtcttaacatcatcatcaagaaccaatggatttgctacaaaaataacaacacatatatgcaaatataaatgaaaaaccataaaagagtttttactcatcaaattggtaaagaagattcaaaccaaaacttaccaccgtgagacagaagtaacttaaccgtgtgtacgagacctctttttgcagcatggtgcagaggagtcccaccattgcaacctaataaattttgaatgaattagctcaaaatatggtttgatgagaggcatatcaagaaattttatagctacaaagaaaatgaattgatgataatagtaccagaacgataagcattgacattggagcccaactcaagcagagtttttgctacatcatatagatcgtcgttcgtacaagctaagattaatggtgttctccctaatttatccaccccctgaatccaaaaccatagtgacaattcagaaaacaagaacaacaccaagaggataattactagagatttggttgaaaaacaaaacaaaaaggcttttaaaaagatgggagtagggaaagaagaaaaacctcgagtcctgctccttcatggtgaagtgatttgataccttcgacgttgttgttactcacttcttgaaacagcatctcatccttggactgtgattgttgttgccccat

SEQ ID NO: 415 - DNA, 2269 bp, Arabidopsis thaliana
  G273 cDNA Sequence
ttccttccttacttgtggagatggagatctgaatctctaaagtttcgatttttatttattcacttttatgcccaaaaagaaaaatcgttactttaaagccaaaaagaagaatacacaaacttcattcactctctcccattctcggatctctctcagtgcacagtggttgtcactcttctcctttggtcgaaactctttcttggaaagagcattttgttatcaagactctgaagagctcttttgggaggatagtaaggttggatgatgagagggagatctgatggaggcctaaagaagcggcttattgcttcggtctgtgtcgtggctctattcgtctgtttcttgtttatgtactatggttcctctagccaaggtgcatcagcattggaatatggaagatctttgagaaaactcggatcgtcttatttgagtggagatgatgataatggtgataccaaacaggatgattctgtggctaatgcagaagacagtcttgttgtcgccaaaagttttcctgtttgtgatgaccggcactcggaaatcatcccttgcttagataggaatttcatctaccaaatgaggttgaagcttgatctctctttaatggaacattatgaacggcattgtcctcctcccgaaagacggtttaattgtttgattcctccaccatctggatacaaggttcctattaagtggcctaagagtagagatgaagtgtggaaagcaaacatacctcacactcaccttgcaaaagagaagtctgatcagaactggatggttgagaaaggcgagaaaatttcttttcccggtggaggcactcatttccattacggtgctgataaatacattgcatcgatcgcaaatatgcttaacttttcgaacgatgtattgaatgacgaagggagattaagaacggttcttgatgtcggatgcggagttgcgagttttggagcttaccttctcgcgtctgatataatgacaatgtcactagcccctaatgatgttcatcagaaccaaatccagtttgcgttagaaagaggaatccctgcttatcttggtgttttaggtaccaaaaggcttccttacccgagcagatcattcgagtttgctcattgttctcgatgtaggattgattggcttcaaagagacggacttcttcttcttgagctcgatcgggtactaagaccgggaggttatttcgcgtattcgtctcctgaagcttacgcacaagatgaagagaatttgaaaatctggaaggagatgagtgctcttgttgaaagaatgtgttggagaattgccgttaaaagaaaccaaactgtggtttggcagaaaccgttgagtaatgactgttacttggagagagagcccgggacacagcctcctctctgtcgctcagatgctgatcctgatgcggttgcgggtgtttcaatggaagcttgcatcactccttactccaagcatgaccataaaaccaagggaagtgggttagctccttggccagctaggttgacttcttctcctccccgtcttgcggatttcggttattcaaccgacatgtttgagaaggacacggaactttggaaacaacaagtggacagttactggaatctgatgtcatcgaaagtcaaatcaaacactgtgaggaacataatggacatgaaagctcacatgggttctttcgcagctgctcttaaagacaaagatgtgtgggtgatgaacgttgtctctcccgacggtcccaacactctaaaactgatctacgaccgtggtttaatcggaacaaatcataactggtgtgaggctttctctacatatcctcgaacatacgatctgttgcacgcgtggtctatattttcagacattaaaagcaaaggatgcagtgcagaggatctactaatcgagatggatcggattcttagacctacgggattcgttatcatcagagataagcagagtgttgttgagtcaatcaagaagtatttgcaggctttgcattgggagactgtggcatcagagaaggtaaatacaagttcagaactcgaccaagacagtgaagatggtgagaacaatgtcgttttcattgtccagaagaaactttggctcaccagtgaaagccttagggacagcgagtaaaaaacatatcaaaagcaaagagagagaaattgttttatcccacaaagtttttatatagttttattttgatttttgtagttgatttgtacgacataaagcattattatataaaatactaaaattattcattgttaaa

SEQ ID NO: 416 - protein, 623 aa, Arabidopsis thaliana
  G273 Amino Acid Sequence
MMRGRSDGGLKKRLIASVCVVALFVCFLFMYYGSSSQGASALEYGRSLRKLGSSYLSGDDDNGDTKQDDSVANAEDSLVVAKSFPVCDDRHSEIIPCLDRNFIYQMRLKLDLSLMEHYERHCPPPERRFNCLIPPPSGYKVPIKWPKSRDEVWKANIPHTHLAKEKSDQNWMVEKGEKISFPGGGTHFHYGADKYIASIANMLNFSNDVLNDEGRLRTVLDVGCGVASFGAYLLASDIMTMSLAPNDVHQNQIQFALERGIPAYLGVLGTKRLPYPSRSFEFAHCSRCRIDWLQRDGLLLLELDRVLRPGGYFAYSSPEAYAQDEENLKIWKEMSALVERMCWRIAVKRNQTVVWQKPLSNDCYLEREPGTQPPLCRSDADPDAVAGVSMEACITPYSKHDHKTKGSGLAPWPARLTSSPPRLADFGYSTDMFEKDTELWKQQVDSYWNLMSSKVKSNTVRNIMDMKAHMGSFAAALKDKDVWVMNVVSPDGPNTLKLIYDRGLIGTNHNWCEAFSTYPRTYDLLHAWSIFSDIKSKGCSAEDLLIEMDRILRPTGFVIIRDKQSVVESIKKYLQALHWETVASEKVNTSSELDQDSEDGENNVVFIVQKKLWLTSESLRDSE

SEQ ID NO: 417 - DNA, 2439 bp, Arabidopsis thaliana
  G273 DNA sequence used for BLAST
ttactcgctgtccctaaggctttcactggtgagccaaagtttcttctggacaatgaaaacgacattgttctcaccatcttcactgtcttggtcgagttctgaacttgtatttaccttctctgatgccacagtctcccaatgcaaagcctgcaaatacttcttgattgactcaacaacactctgcttatctctgatgataacgaatcccgtaggtctaagaatccgatccatctcgattagtagatcctctgcactgcatcctttgcttttaatgtctgaaaatatagaccacgcgtgcaacagatcgtatgttcgaggatatgtagagaaagcctcacacctaaattaaaaccggaaacaaaaaaaaagaatggtgaaaatatgaactagtgtgacaagtgagagaatgttttcgattttcaggtttcgggtgtgtaccagttatgatttgttccgattaaaccacggtcgtagatcagttttagagtgttgggaccgtcgggagagacaacgttcatcacccacacatctttgtctttaagagcagctgcgaaagaacccatgtgagctttcatgtccattatgttcctcacagtgtttgatttgactttcgatgacatcagattccagtaactgtccacttgttgtttccaaagttcctgtaaacaaagaagataagcaaagcaatgtgctttttcaataaatctgtggaagaatgatgattaagtaagatcaatggttgcgaaaagatggcagttatagtaccgtgtccttctcaaacatgtcggttgaataaccgaaatccgcaagacggggaggagaagaagtcaacctagctggccaaggagctaacccacttcccttggttttatggtcatctgtatttaaaaaaaacaaagcatgactgtgacatatggcatacaaaacaaaagatctggtcctaattcctcaaaactcaaaataaccaacggaacagaaaaaagaagcaaatacttacgcttggagtaaggagtgatgcaagcttccattgaaacacccgcaaccgcatcaggatcagcatctgagcgacagagaggaggctgtgtcccgggctctctctccaagtaacagtcattactcaacggtttctgccaaaccacagtttggtttcttttaacggcaattctccaacacattctttcaacaagagcactcatctccttccagattttcaaattctcttcatcttgtgcgtaagcttcaggagacgaatacgcgaaataacctcccggtcttagtacccgatcgagctcaagaagaagaagtccgtctctttgaagccaatcaatcctacatcgagaacaatgagcaaactcgaatgatctgctcgggtaaggaagccttttggtacctaaaacaccaagataagcagggattcctctttctaacgcaaactggatttggttctgatgaacatcattaggggctagtgacattgtcattatatcagacgcgagaaggtaagctccaaaactcgcaactccgcatccgacatcaagaaccgttcttaatctcccttcgtcattcaatacatcgttcgaaaagttaagcatctgcaaagtcaaaaaatcattagagacaagttatcactagaaataaaaagtgagcaaaagactcttacatttgcgatcgatgcaatgtatttatcagcaccgtaatggaaatgagtgcctccaccgggaaaagaaattttctcgcctttctcaaccatccagttctgatcagacttctcttttgcaaggtgagtgtgaggtatgtttgctttccacacttcatctctactcttaggccacttaataggaacctaaacgcaaatcaatacaaagaacaaaacaatatcaagacaatgtaaccaggaaccaatcacaaatcaaagcaaaacaagaaagcaaatatagcaccttgtatccagatggtggaggaatcaaacaattaaaccgtctttcgggaggaggacaatgccgttcataatgttccattaaagagagatcaagcttcaacctcatttggtagatgaaattcctatctaagcaagggatgatttccgagtgccggtcatcacaaaccttaacatttaaaccataagttagctaacattattaacatatctcaaccagttaccagacctgagaatctgatcaaacttacaggaaaacttttggcgacaacaagactgtcttctgcattagccacagaatcatcctgtttggtatcaccattatcatcatctccactcaaataagacgatccgagttttctcaaagatcttccatattccaatgctgatgcaccttggctagaggaaccatagtacataaacaagaaacagacgaatagagccacgacacagaccgaagcaataagccgcttctttaggcctccatcagatctccctctcat

SEQ ID NO: 418 - DNA, 2371 bp, Arabidopsis thaliana; identical to SEQ ID NO: 75
  G274 cDNA Sequence

SEQ ID NO: 419 - protein, 621 aa, Arabidopsis thaliana
  G274 Amino Acid Sequence
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 420 - DNA, 2418 bp, Arabidopsis thaliana
  G274 DNA sequence used for BLAST
ttattcttcttcactattagaagacgacggagaattgtttccatcgtcgccggctacccaatactgcttcgtggcgacaagaatcttctccggcacgagaggaccgtcttcatgatccattaacttagtatcccatctcattccatcaacgatcttcctcacatcattcaaaacatcaacctcatcccggaaaatcacaatcccttccggtcgtaaaatccgatcagtttcaagaagaatatcctcaagtttgcagctgccaacatgaaattgacccattacttaaacaaccctagtacagaattgaaaaattcatcactagttctcaaaaagtttgtagctttagggtttagatcaatggttggtaattctcagaaagttcatagctttaaggttaaaacaagtgtttactaattctcagaaagttcatagctttgggtttcacttcaacgttgctaagtctcagaaagtttgtagctttagggctaaataaagggttgctttgattctcagaaagtgtggagctttaaggttaagttagggtttataatcattacctgtgctgatacaagctgaagacaccactagcgtgaatgaaatcgtatgttcttggataagttgaaaagccttcacacctacagagatttgaacagtagagattgtatgattgttgccattgatggaaggaagataaagatttgtgtgtggatagatgttttaccagtcatgatagataccaatgagacctctctcataaacaacactcaatgtgttcttgttaatggttggaatcacattcataacccacgatttaggcgattcaagcgcagcagcgaatccaccaagaccggcgttcatatccatcacattacggtatctggtggaacctatcagtctgttaattctcttgtatccggtcactcgcttcttccatagattgatgtcttcttggtatgattcctcgtcgacgccattaatcaaacctttagagatacttggaggcactgcgaatagcctctcggggaacttctttagctttcctccagcaacttcttcttcgtttgatactttagggaatggtgttacacacgtttctatctccttgtaccagacatcgtcagtgtcctttcttttgcaggtgtcaaccggtgttgatctatcgcatgatctatcgtttattttctttctgaaaattgcaatgtctcccttctcatacttcttctcccagcataaggactctgcgattccctctattctcttttgctcggcatttagctctgctttagttcggttccacgtcttgtgccatgtcttccagttgattggaggacccgataagacccagtaacctccaggtctcaagactctatctacttccattaagtatgttccctctgtacaagcaatcaagaagcaaagacaccaatatgagtacaagcaagaaatggattttcgcctaatttgatagttaatatttaccgtttgcggtccatggtatcaagcatcgagagcattgagccatgtcaaaggctcttgcagggtaaggaagaaggattgatccaagaacagcgataatcgctggaacacctctctcaagcgcaaactggacttgtgcttcgtggttatcccttggcgcaaacgacatagtcaaaacattcctcttaagcatataagcaccccaactagcaacctagagatggtaaattagcatcaataagaatctaagaaatgaataagatatgttactagatcaaacagaaatcgacttaccccacatccagtgtccaatgcggttctaacagagccatctttgatagggataacagaagctagctcttcaatatacgcatcagcaccttgaggaaacatagttcctccaccagggaatttaaacacattcccttgaaactgaacccaattctgtccagctttttcgacagtcaagctcttgaaaggagcattagcatagtgaacataatctctgcttttaggccaagggaaaggagtcatataccctttaggagctggaacaagacaacgcagcttctcattatcaggaggacaatgtctctctctgtaaatcatgttctctctcgggaacttcatagctcggtcttgctcttgacaaggcgtgtaatccttgagcttcacatcacacggtttgaaagaaacaggtttgggatcagctttatgtgggatcttcactgtgttgtgatgaggttcaaaatcaagatcagtgacaatgtcagtacactgcgcttgctttgtaatctccatagctatgctatctcctttaccaaacccactcttttgccatgctccaagaagatagaagaaacaacataaaccaaccacaacgagtagagatagtgtacttctcgatctgttattccctggtgggttatgcttagaacccat

SEQ ID NO: 421 - DNA, 781 bp, Arabidopsis thaliana
  G279 cDNA Sequence
cacaaacacgtagttattctctctttactctctctatttctctctcttcaaaccctacgaagatcttcttcttcttcttcaagaatcgatcatgaaaggagctaaatctaaggctgaaaccaggagcacaaagctctctgtgactaagaagcctgctaagggagccaaaggtgctgctaaagatccaaacaaacctaagaggccttccagtgccttcttcgttttcatggaagatttccgtgtgacgtacaaggaggagcaccctaagaacaagtctgttgctgctgttggcaaagctggtggtgaaaagtggaaatccttgtctgactctgagaaggctccttatgtggctaaggctgacaagcgcaaggttgagtatgagaagaacatgaaagcctacaacaagaaattggaggaaggccctaaggaagatgaggaatctgacaagtcagtttcagaggttaacgatgaggatgatgctgaggatggcagtgaagaggaggaagacgatgattaagaagttgaagttgtggtagcgtaatatagaaggctgcaaggaatctctcggatgtttttatctcctctcttaaaatgttaattcgggtggttaaagtggtttttttttttttctttttctttttcttactgatgtttcgttttagtaaactattacctatctcccactgattctacgggtaatggaaaaagtgaatgtagaatgtttagatggtgaaatgagagatttgtagctctaaaaaaaaaaaaaaaaaaaaaaaaaaaa

SEQ ID NO: 422 - protein, 141 aa, Arabidopsis thaliana
  G279 Amino Acid Sequence
MKGAKSKAETRSTKLSVTKKPAKGAKGAAKDPNKPKRPSSAFFVFMEDFRVTYKEEHPKNKSVAAVGKAGGEKWKSLSDSEKAPYVAKADKRKVEYEKNMKAYNKKLEEGPKEDEESDKSVSEVNDEDDAEDGSEEEEDDD

SEQ ID NO: 423 - DNA, 1350 bp, Arabidopsis thaliana
  G279 DNA sequence used for BLAST
atgaaaggagctaaatctaaggctgaaaccaggagcacaaagtgagttaattcacatagatcgatttttatttttttgtttgctagttagttcctagatctctggatttcagatccgaattcaaaaatcgttgtcgttttcttacttattgttttgtggtgatggatgatataggctctctgtgactaagaagcctgctaagggagccaaaggtgctgctaaagatccaaacaaacctaagaggccttccagtgccttcttcgttttcatgtaatccttcgaatcttcacttttatctctgtttagtacttgtggtttgtttctatggaataactttattctggtaaaaagtttttgagtattgactttgtacgaatctgttcaaaagcgaaaatagtaccattttctgttcagaactgatttgtatatattgatgttattgttcacacctaaatgtactggaacgttgactgcattatttataagctgattcttctatttaagttatttgtgctataacttgcgttgatttatgatttgtagggaagatttccgtgtgacgtacaaggaggagcaccctaagaacaagtctgttgctgctgtgagttgtgatttgatgcttttccataacttatttgatgtgtttttgtttttttggccgtagcttttgtgtttgaagttgttgctgacaatgagtttcaatggattataggttggcaaagctggtggtgaaaagtggaaatccttgtctgactctgtacgttttctaagcttagttagccaaagttgtgtgtattaagtcaattgtttcaagcgttttattaacctgtgggtgttataataatgcaggagaaggctccttatgtggctaaggctgacaagcgcaaggttgagtatgagaagaacatgaaagcctacaacaagaaattggtaattgtttatttgcatatagaaggctatgttatgtttatattaaccacgttattgagttgtctactctctttatactagtcagtagtcacactattcaaggctttcttaatttgtttactatatattgaagtttgagttatgtttattctaaacaatgatgatacaagcaactggtaatttggttaatgggggtgcttgaataatggtggtgtgttgtggtttcaggaggaaggccctaaggaagatgaggaatctgacaagtcagtttcagaggttaacgatgaggatgatgctgaggatggcagtgaagaggtaagttattttacacctctgcaatctaaatatctgtagtatgaatcagtaaagctttgtattaactctgttatacatgtgatgtaggaggaagacgatgattaa

SEQ ID NO: 424 - DNA, 1775 bp, Arabidopsis thaliana
  G285 cDNA Sequence
tagagatccaaaacctcacaaatttcgaccgagttttgttgaattccgattagatctttcttccacgaaacccccccaagtacccattccatcttctcggtgagtctcccatgttggcattacgctagggttcttcttctctgtggtttcgcataacccaataatccaattttctacttgggcatcaatgggtcgctctcgagggaacttccaaaatttcgaagaccctactcagagaacgaggaaaaagaaaaatgcggctaatgtggagaactttgagtctacttctttggtaccaggtgctgagggaggagggaagtataactgcgattattgccagaaagacattactggaaaaattaggataaagtgtgctgtctgtccagattttgatctctgtatagaatgtatgtctgttggagcagagatcactcctcacaaatgtgatcacccataccgagttatgggaaatctaactttcccgcttatttgtcctgactggagtgcggatgatgaaatgcttctcctggagggacttgaaatttatggcttgggaaactgggcagaggttgcggagcacgtgggaacgaagagtaaagaacagtgtcttgagcactacagaaacatctatttgaactcaccatttttcccacttccggatatgtcacatgtagcagggaagaacagaaaagaacttcaagccatggctaaaggacgcattgatgacaagaaagagcagaacatgaaagaagagcacccgttctctcctcctaaagtcaaagttgaagacacacaaaaagagtcttttgtagacagaagttttggagggaagaaacctgtttccacctcggtaaacaactctttggttgagctgagtaattacaaccagaaaagagaagagtttgaccctgaatatgacaatgatgctgagcaactcttggcggagatggagttcaaagagaacgatactcctgaagaacatgaactgaagctgcgtgtgttgcgtatctattcaaaaaggcttgatgagaggaaacgtagaaaagaattcataatagaaagaaacctgttgtacccaaatccctttgagaaggacctgtctcaggaggagaaagtacaatgccgacgtttggacgtttttatgcgttttcattcaaaagaggagcacgacgagctactccgtaatgttgtaagcgagtaccgcatggtgaaacggctcaaagatctcaaggaagctcaagtggcagggtgtcgttcaacggctgaagcagagaggtatctgggaaggaagaggaagagagaaaacgaagaagggatgaacagagggaaagagagcggtcaatttggtcaaattgcaggggagatgggctctagaccacctgtgcaagcttcttcaagctatgtgaatgatttggacttgattgggttcacggagtcgcaactgctgtctgaatccgaaagcgtctctgcagcgaggtcaagttggttccaccggtttatctacagatgcaacaagtgatgtcacatgagatattcaaagggaatgtaccgaagaagtcggatgcatatagccttttcaagattgatccaaccaaagtggatcgagtttatgatatgcttgtgaagaagggtattgctcaactttaaggcttgtgtagtgttgtatcatatatataaatgtgtgagctctaatgagttatttgttgacattcccttgtttattacaccttgtcaaaattagtttgtaatagaaaaacgattacggtttgaataaa

SEQ ID NO: 425 - protein, 443 aa, Arabidopsis thaliana
  G285 Amino Acid Sequence
MGRSRGNFQNFEDPTQRTRKKKNAANVENFESTSLVPGAEGGGKYNCDYCQKDITGKIRIKCAVCPDFDLCIECMSVGAEITPHKCDHPYRVMGNLTFPLICPDWSADDEMLLLEGLEIYGLGNWAEVAEHVGTKSKEQCLEHYRNIYLNSPFFPLPDMSHVAGKNRKELQAMAKGRIDDKKEQNMKEEHPFSPPKVKVEDTQKESFVDRSFGGKKPVSTSVNNSLVELSNYNQKREEFDPEYDNDAEQLLAEMEFKENDTPEEHELKLRVLRIYSKRLDERKRRKEFIIERNLLYPNPFEKDLSQEEKVQCRRLDVFMRFHSKEEHDELLRNVVSEYRMVKRLKDLKEAQVAGCRSTAEAERYLGRKRKRENEEGMNRGKESGQFGQIAGEMGSRPPVQASSSYVNDLDLIGFTESQLLSESESVSAARSSWFHRFIYRCNK

SEQ ID NO: 426 - DNA, 2843 bp, Arabidopsis thaliana
  G285 DNA sequence used for BLAST
tcacttgttgcatctgtagataaaccggtggaaccaacttgacctcgctgcagagacgcttctcctgcaaaacaaagagctttcttctttcagttacaacgacagaaaactcatctcacactgttcagtatctcagttctcagacacttacggattcagacagcagttgcgactccgtgaacccaatcaagtccaaatcattcacatagcttgaagaagcttgcacaggtggtctagagcccatctcccctgcaatttgaccaaattgaccgctctctttccctctgttcatcccttcttcgttttctctcttcctcttccttcccagatacctctctgcttcagccgttgaacgacaccctgccacttgagcttcctgctccaccaatccaacacagtgagccacatccaatccaagaaaccaaacgcacagtttgagggtagcaatgtccttaccttgagatctttgagccgtttcaccatgcggtactcgcttacaacattacggagtagctcgtcgtgctcctcttttgaatgaaaacgcataaaaacgtccaaacgtcggcattgtactttctcctcctgagacaggtccttctcaaagggatttgggtacaacaggtttctttctattatgaattcttttctacgtttcctctcatcaagcctacaaacatcatactcacctgcgtcagaatggacagcaaaaagaagagactttgtcccccttttgatcttaaatgttgtacctttttgaatagatacgcaacacacgcagcttcagttcatgttcttcaggagtatcgttctctttgaactccatctccgccaagagttgctcagcatcattgtcatattcagggtcaaactcttctcttttctggttgtaattactcagctcaaccaaagagttgtttaccgaggtggaaacaggtttcttccctccaaaacttctgtctacaaaagactctaaccacaaagaatgtcaaaacatagaaaaagggagaaaatatctaccagtataaatacaatgacaaatattgggcctttttggattttaaaattatgctcagtcagcttcttactttacaagtagatgattccatttacgcgatggttaactagattataactactggtgtaagctagagcaagtaaataacaaaacgataagcacacctatatacgaaccagatatagcatacaaagcaagaactcacctttttgtgtgtcttcaactctgcaagaaaattgaacaaaagatgagaaaattatagggttatcactgtacagtacatgagaagaacgagaaacatacttgactttaggaggagagaacgggtactcttctttcatgttctgctctgctgccaaagaagaaaccacttcaaaatcagaattaaaatagcaacacgtacaacgcagaatcaaaaccatcaagcaaagaagcgcatacctttcttgtcatcaatgcgtcctttagccatggcttgaagttcttttctgttcttccctgctacatgtgacatatcctgggaaaataaacgtttctcctgaattagttaataccttgcaaaaggctggcactactgaggtagataggtatcttatcagatcgatgtagcataccggaagtgggaaaaatggtgagttcaaatagatgtttctgtagtgctcaagacactgttctttactcttcgttcccacgtgctccgcaacctctgcccagtttcccaagccataaatttcaagtccctgaataaagacattaaaagaaattacttttcactgaaagaatcagacattatagacttcatatcagtacgataaaagaagtagtggtacctccaggagaagcatttcatcatccgcactccagtcaggacaaataagcgggaaagttagatttccctaacaaagcaaatgaaacatatattaagctttggtagaattcaaccaaaagatattttcgctaagtataatgaatcaaactctttccaaactaaaaggtaagaaaagtaaatgaaaactaaccataactcggtatgggtgatcacatttgtgaggagtgatctctgctccaacagacatacattctatacagagatcaaaatctggacagacagcacactttatcctaatttttccagtaatgtctttctggcaataatcgcagttatacttccctcctccctcagcacctggtactgtctccacaaataaaaaatgttgagtaaaagaagaatcttgacaggagaaacaaaaaaaaaaaaccttgataagtatttttttacccaaagaagtagactcaaagttctccacattagccgcatttttctttttcctcgttctgcaacaaacgcataacacgattctttcatgtcagcttcaacagtgaaaaaacaattacacagatgaaaacagagaagagactacatagctactgaaagttttcaaaagcaacaaactttaagcgatgctcattgtcccaactgaaaaatcaatgattgttgcacaaagcagatgcaaagaaacttcaaaatcaatcaatttcagcagaaattggcacaattacatagatgaagatagaggagactatagctactgaaagttatcaaaagccacaaatttgaagccatgctcattgtcccaactagagatcaatgacaattgcacaacacagactcaaagaaacttgaaattcaaatcaatttcagcacaaattggcaattacaaaagagaaatccacaaaaaccccaaatcggaaattagagtagtgaattaggaacaaacctctgagtagggtcttcgaaattttggaagttccctcgagagcgacccat

SEQ ID NO: 427 - DNA, 1351 bp, Arabidopsis thaliana
  G291 cDNA Sequence
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcaagacaaagatctttgggttattaaatgacattaacataaaaaaaa

SEQ ID NO: 428 - protein, 357 aa, Arabidopsis thaliana
  G291 Amino Acid Sequence
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 429 - DNA, 2014 bp, Arabidopsis thaliana
  G291 DNA sequence used for BLAST
atggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggtaagatatctcttattcatctctcgctgtagctccttgtttaattagctagttgctacttggatcctttatgcaagattttgcgagtgtttgattgattggttatgactgtaactttgaactataggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacaggtatgtataattcttatttatcgattttaaaacttgggagggttttaatcatcgatcttatgattcattttttttgtatgtggcagtactactcattggacatcacttatttcaagtcatctctcgatagtcaccttctggatctcctttggaacaagtactgggtgaacactctttcttcttccccactgttgggcaatggagactatgttgccgggcaaatatcagacttgggtaaattcttgtatatatgaaagagcaagttaatttacttttcatccaggtcgtagtttgatatatcctcttttcttaccatttaattgtttacatgatgaagctgagaagctcgagcaagcggagagtcagctcgctaactcccggtatggaggaattgcgccagccggtcaccaaaggaggaaagaggtttgtctaaatggttgctttagcaaaattatttgttatgttctcaatgtttattgactgtctgagatactggaccatgatcttgagctcatacacttgccacttttcaagcttgttcctgtgtagaaacttttcatttggctaattaactgctactatcaacatctagcaacttggattaaatttgaactttttattcttaggcattatgttgactggatattgactaatagaaactctacctgcaaaacactatgttttaccttttctgggtttgaaatttcacaattgagtgtatgtttagtcaaaaatatacagagctattaaagtttgaactagtaaaacagggagactttgatgtatcaatttgtcaacgagttgttgccaatagtctatgtctgcttcctagagttctgttatctctggctgtgtgactcattttgatattgttttaatcttctttacataaaaacatttgttttggagattacattacctaagtatatgtgttgtggaccactttcaggatgagcctcaactcgcgaagataactcgggatagtgcaaagataactgtcgagcaggtccatggactaatgtcacaggtgagtaaatacaatctgacaatgctgatcctatttccccttgcggttaatggatccatgaaattgacttaaaaagtctttcatccatcaatgtgcaggttatcaaagacatcttgttcaattccgctcgtcagtccaagaagtctgctgacgactcatcagatccagagcccatgattacatcgtga

SEQ ID NO: 430 - DNA, 1962 bp, Arabidopsis thaliana
  G306 cDNA Sequence
atggcggaatccggcgatttcaacggtggtcaacctcctcctcatagtcctctgagaacaacttcttccggtagtagcagcagcaacaaccgtggtcctcctcctcctcctcctcctcctttagtgatggtgagaaaaagattagcttccgagatgtcttctaaccctgactacaacaactcctctcgtcctcctcgccgtgtctctcaccttcttgactccaactacaatactgtcacaccacaacaaccaccgtctcttacggcggcggctactgtatcttctcaaccaaacccaccactctctgtttgtggcttctctggtcttcccgtttttccttcagaccgtggtggtcggaatgttatgatgtccgtacaaccaatggatcaagactcttcatcttcttctgcttcacctactgtatgggttgacgccattatcagagaccttatccattcctcaacttcagtctctattcctcaacttatccaaaacgttagagacattatcttcccttgtaacccaaatctcggtgctcttcttgaatacaggctccgatctctcatgctccttgatccttcctcttcctctgacccttctcctcaaactttcgaacctctctatcagatctccaacaatccttctcctccacaacagcaacagcagcaccaacaacaacaacaacagcataagcctcctcctcctccgattcagcagcaagaaagagaaaattcttctaccgatgcaccaccgcaaccagagacagtgacggccactgttcccgccgtccaaacaaatacggcggaggctttaagagagaggaaggaagagattaagaggcagaagcaagacgaagaaggattacaccttctcacattgctgctacagtgtgctgaagctgtctctgctgataatctcgaagaagcaaacaagcttcttcttgagatctctcagttatcaactccttacgggacctcagcgcagagagtagctgcttacttctcggaagctatgtcagcgagattactcaactcgtgtctcggaatttacgcggctttgccttcacggtggatgcctcaaacgcatagcttgaaaatggtctctgcgtttcaggtctttaatgggataagccctttagtgaaattctcacactttacagcgaatcaggcgattcaagaagcatttgagaaagaagacagtgtacacatcattgacttggacatcatgcagggacttcaatggcctggtttattccacattcttgcttctagacctggaggacctccacacgtgcgactcacgggacttggtacttccatggaagctcttcaggctacagggaaacgtctttcggatttcacagataagcttggcctgccttttgagttctgccctttagctgagaaagttggaaacttggacactgagagactcaatgtgaggaaaagggaagctgtggctgttcactggcttcaacattctctttatgatgtcactggctctgatgcacacactctctggttactccaaagattagctcctaaagttgtgacagtagtggagcaagatttgagccacgctggttctttcttaggaagatttgtagaggcaatacattactactctgcactctttgactcactgggagcaagctacggcgaagagagtgaagagagacatgtcgtggaacagcagctattatcgaaagagatacggaatgtattagcggttggaggaccatcgagaagcggtgaagtgaagtttgagagctggagggagaaaatgcaacaatgtgggtttaaaggtatatctttagctggaaatgcagctacacaagcgactctactgttgggaatgtttccttcggatggttacactttggttgatgataatggtacacttaagcttggatggaaagatctttcgttactcactgcttcagcttggacgcctcgttcttag

SEQ ID NO: 431 - protein, 653 aa, Arabidopsis thaliana
  G306 Amino Acid Sequence
MAESGDFNGGQPPPHSPLRTTSSGSSSSNNRGPPPPPPPPLVMVRKRLASEMSSNPDYNNSSRPPRRVSHLLDSNYNTVTPQQPPSLTAAATVSSQPNPPLSVCGFSGLPVFPSDRGGRNVMMSVQPMDQDSSSSSASPTVWVDAIIRDLIHSSTSVSIPQLIQNVRDIIFPCNPNLGALLEYRLRSLMLLDPSSSSDPSPQTFEPLYQISNNPSPPQQQQQHQQQQQQHKPPPPPIQQQERENSSTDAPPQPETVTATVPAVQTNTAEALRERKEEIKRQKQDEEGLHLLTLLLQCAEAVSADNLEEANKLLLEISQLSTPYGTSAQRVAAYFSEAMSARLLNSCLGIYAALPSRWMPQTHSLKMVSAFQVFNGISPLVKFSHFTANQAIQEAFEKEDSVHIIDLDIMQGLQWPGLFHILASRPGGPPHVRLTGLGTSMEALQATGKRLSDFTDKLGLPFEFCPLAEKVGNLDTERLNVRKREAVAVHWLQHSLYDVTGSDAHTLWLLQRLAPKVVTVVEQDLSHAGSFLGRFVEAIHYYSALFDSLGASYGEESEERHVVEQQLLSKEIRNVLAVGGPSRSGEVKFESWREKMQQCGFKGISLAGNAATQATLLLGMFPSDGYTLVDDNGTLKLGWKDLSLLTASAWTPRS

SEQ ID NO: 432 - DNA, 2163 bp, Arabidopsis thaliana
  G306 Genomic Sequence
ccttatttataaccatgcaatctcacgaccaacaacccttcaatctccatggcggaatccggcgatttcaacggtggtcaacctcctcctcatagtcctctgagaacaacttcttccggtagtagcagcagcaacaaccgtggtcctcctcctcctcctcctcctcctttagtgatggtgagaaaaagattagcttccgagatgtcttctaaccctgactacaacaactcctctcgtcctcctcgccgtgtctctcaccttcttgactccaactacaatactgtcacaccacaacaaccaccgtctcttacggcggcggctactgtatcttctcaaccaaacccaccactctctgtttgtggcttctctggtcttcccgtttttccttcagaccgtggtggtcggaatgttatgatgtccgtacaaccaatggatcaagactcttcatcttcttctgcttcacctactgtatgggttgacgccattatcagagaccttatccattcctcaacttcagtctctattcctcaacttatccaaaacgttagagacattatcttcccttgtaacccaaatctcggtgctcttcttgaatacaggctccgatctctcatgctccttgatccttcctcttcctctgacccttctcctcaaactttcgaacctctctatcagatctccaacaatccttctcctccacaacagcaacagcagcaccaacaacaacaacaacagcataagcctcctcctcctccgattcagcagcaagaaagagaaaattcttctaccgatgcaccaccgcaaccagagacagtgacggccactgttcccgccgtccaaacaaatacggcggaggctttaagagagaggaaggaagagattaagaggcagaagcaagacgaagaaggattacaccttctcacattgctgctacagtgtgctgaagctgtctctgctgataatctcgaagaagcaaacaagcttcttcttgagatctctcagttatcaactccttacgggacctcagcgcagagagtagctgcttacttctcggaagctatgtcagcgagattactcaactcgtgtctcggaatttacgcggctttgccttcacggtggatgcctcaaacgcatagcttgaaaatggtctctgcgtttcaggtctttaatgggataagccctttagtgaaattctcacactttacagcgaatcaggcgattcaagaagcatttgagaaagaagacagtgtacacatcattgacttggacatcatgcagggacttcaatggcctggtttattccacattcttgcttctagacctggaggacctccacacgtgcgactcacgggacttggtacttccatggaagctcttcaggctacagggaaacgtctttcggatttcacagataagcttggcctgccttttgagttctgccctttagctgagaaagttggaaacttggacactgagagactcaatgtgaggaaaagggaagctgtggctgttcactggcttcaacattctctttatgatgtcactggctctgatgcacacactctctggttactccaaaggtaaaataaacattaccttttaatcactctttatctataaattattttaagattatataggaaagatatgttctaaaaagctggcttttttggttaatgattggggaatgaacagattagctcctaaagttgtgacagtagtggagcaagatttgagccacgctggttctttcttaggaagatttgtagaggcaatacattactactctgcactctttgactcactgggagcaagctacggcgaagagagtgaagagagacatgtcgtggaacagcagctattatcgaaagagatacggaatgtattagcggttggaggaccatcgagaagcggtgaagtgaagtttgagagctggagggagaaaatgcaacaatgtgggtttaaaggtatatctttagctggaaatgcagctacacaagcgactctactgttgggaatgtttccttcggatggttacactttggttgatgataatggtacacttaagcttggatggaaagatctttcgttactcactgcttcagcttggacgcctcgttcttagttttcttctcctttttcacaaacaatgtgcccataaat

SEQ ID NO: 433 - DNA, 2076 bp, Arabidopsis thaliana
  G306 DNA sequence used for BLAST
atggcggaatccggcgatttcaacggtggtcaacctcctcctcatagtcctctgagaacaacttcttccggtagtagcagcagcaacaaccgtggtcctcctcctcctcctcctcctcctttagtgatggtgagaaaaagattagcttccgagatgtcttctaaccctgactacaacaactcctctcgtcctcctcgccgtgtctctcaccttcttgactccaactacaatactgtcacaccacaacaaccaccgtctcttacggcggcggctactgtatcttctcaaccaaacccaccactctctgtttgtggcttctctggtcttcccgtttttccttcagaccgtggtggtcggaatgttatgatgtccgtacaaccaatggatcaagactcttcatcttcttctgcttcacctactgtatgggttgacgccattatcagagaccttatccattcctcaacttcagtctctattcctcaacttatccaaaacgttagagacattatcttcccttgtaacccaaatctcggtgctcttcttgaatacaggctccgatctctcatgctccttgatccttcctcttcctctgacccttctcctcaaactttcgaacctctctatcagatctccaacaatccttctcctccacaacagcaacagcagcaccaacaacaacaacaacagcataagcctcctcctcctccgattcagcagcaagaaagagaaaattcttctaccgatgcaccaccgcaaccagagacagtgacggccactgttcccgccgtccaaacaaatacggcggaggctttaagagagaggaaggaagagattaagaggcagaagcaagacgaagaaggattacaccttctcacattgctgctacagtgtgctgaagctgtctctgctgataatctcgaagaagcaaacaagcttcttcttgagatctctcagttatcaactccttacgggacctcagcgcagagagtagctgcttacttctcggaagctatgtcagcgagattactcaactcgtgtctcggaatttacgcggctttgccttcacggtggatgcctcaaacgcatagcttgaaaatggtctctgcgtttcaggtctttaatgggataagccctttagtgaaattctcacactttacagcgaatcaggcgattcaagaagcatttgagaaagaagacagtgtacacatcattgacttggacatcatgcagggacttcaatggcctggtttattccacattcttgcttctagacctggaggacctccacacgtgcgactcacgggacttggtacttccatggaagctcttcaggctacagggaaacgtctttcggatttcgcagataagcttggcctgccttttgagttctgccctttagctgagaaagttggaaacttggacactgagagactcaatgtgaggaaaagggaagctgtggctgttcactggcttcaacattctctttatgatgtcactggctctgatgcacacactctctggttactccaaaggtaaaataaacattaccttttaatcactctttatctataaattattttaagattatataggaaagatatgttctaaaaagtggcttttttggttaatgattggggaatgaacagattagctcctaaagttgtgacagtagtggaacaagatttgagccacgctggttctttcttaggaagatttgtagaagcaatacattactactctgcactctttgactcactgggagcaagctacggcgaagagagtgaagagagacatgtcgtggaacagcagctattatcgaaagagatacggaatgtattagcggttggaggaccatcgagaagcggtgaagtgaagtttgagagctggagggagaaaatgcaacaatgtgggtttaaaggtatatctttagctggaaatgcagctacacaagcgactctactgttgggaatgtttccttcggatggttacactttggttgatgataatggtacacttaagcttggatggaaagatctttcgttactcactgcttcagcttggacgcctcgttcttag

SEQ ID NO: 434 - DNA, 1764 bp, Arabidopsis thaliana; identical to SEQ ID NO: 76
  G307 cDNA Sequence

SEQ ID NO: 435 - protein, 587 aa, Arabidopsis thaliana
  G307 Amino Acid Sequence
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAAESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAH

SEQ ID NO: 436 - DNA, 1764 bp, Arabidopsis thaliana; identical to SEQ ID NO: 76
  G307 Genomic Sequence

SEQ ID NO: 437 - DNA, 1764 bp, Arabidopsis thaliana
  G307 DNA sequence used for BLAST
tcagtacgccgccgtcgagagtttccaagcggaggtggtaatgagtggacgagtgtgccaacccaacatcaaacatccattactctcctccacacgataaccttggccactattaaacacagacaaaagcatactcgcttgcttaaacgcgttagacccaagatgtgccggcgctaaaccggacgaaccaaaccggtttccccattgactcaacgtttcgtgtctctcgactctgtcaggaccttcacaagccaccagattacaaatctgtttccctaagtaaacttcagacatgactttgtcttgactattcggaactccttccaacgaatcaaacagagtcgaataataatgtaacgattcagtaaaccggtctaagaaaaccggtccgttatggttcgattcttgctcaaccaccgtgaaaatcaccggtttaatctgtttcacaacgccgagaactttctctatcccaccgggacgacctaagagcttatgtagctcaaaaacagagttcaccgcaacagcttccgtatcgctcggtctaagctcaagcatcgaagcatcgagatcggctaagctgttagcaacgaatccacggtattcgaattctacgtgaatcgcctccgcaagctgagctaatttacaaccaacttcatgaagatgatcagaattatccggcgccggtggaccaattccggttaaccggaaagttggaggacctccttctcgaagcgcaagagcttgcataagtgcaggccattgaagaccttggttcatcgagaaatcaatgacgtgtactctcttcttaccttcaaaagcttcgagaatcgcttggttcgccgtgaagtgagcgaatttaagataaggacaagtctcgtaaaagtgcatctgaagagtatcggagagacaatgatcgatctgattctgcggcggagagagacggtagatccgccgcgctaaagcttcggcgaagtaagtagccacttttctcatagctccggcttgagacacagctaagcatccgatttgcttcacaagagcttccgctagagtcaaattgttctgctggattgcttctgcacaagccataagcgcgtggactaaacgaacaccgttctcttgcgagtcaaccaggataacagaacgagttgactcacccgccgccgtcgttgtcgtggtggttgtcgtcaccgtcgttcctatgactccaccaatctgcgtacccgtcgaagtcgatgtaaccatagaatcaggactcgagcatgatttcaaacgcttgttctgattattcgacgaagacgaagaatcaatcgccggaaactgataaatcgcgtttccgggaatgactttaaggtcataatccgaagccggaaaaccacaaatctccggcgaaggaagaaccggatctaaaccgttagaactcgccggaagaggaggaggattaagctcagagagcatattatcaagccaagaataaagctccgacggattataatgaacagtatccgtcgcgagatgagataaaccatcttcttgaacattactcatcatcgtctctaattgttcgagtttcaaagcaacctccgccatctccgatgacctaactttgtaacctaaaacagcgagaagctcgtcgtccatgttacctccaccgtcttcttcttttttcaccatcatcatcttatctttagagattgatgatgatgaagaagaagtcccgtggttggacaatcgaccttggaattggtgatgatctctcttcat

SEQ ID NO: 438 - DNA, 1951 bp, Arabidopsis thaliana; identical to SEQ ID NO: 66
  G308 cDNA Sequence

SEQ ID NO: 439 - protein, 532 aa, Arabidopsis thaliana
  G308 Amino Acid Sequence
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 440 - DNA, 1602 bp, Arabidopsis thaliana
  G308 Genomic Sequence
atgaagagagatcatcatcatcatcatcatcaagataagaagactatgatgatgaatgaagaagacgacggtaacggcatggatgagcttctagctgttcttggttacaaggttaggtcatccgaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccactacagcgacggctgagtcaactcggcatgttgtcctggttgactcgcaggagaacggtgtgcgtctcgttcacgcgcttttggcttgcgctgaagctgttcagaaagagaatctgactgtagcggaagctctggtgaagcaaatcggattcttagccgtttctcaaatcggagcgatgagaaaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattag

SEQ ID NO: 441 - DNA, 1602 bp, Arabidopsis thaliana; identical to SEQ ID NO: 440
  G308 DNA sequence used for BLAST

SEQ ID NO: 442 - DNA, 1128 bp, Arabidopsis thaliana
  G313 cDNA Sequence
atggaagctacagtcaaaatattctattatggaactggagtcaagagtaagattcgggaacttgaggtctcgctgctgagtggtgatactaaagttgaagaattctcaggttttagccccgctgctgggaagtcgtggaactgggatgaacttttggctttgactccacagttggacttgaaagaggtgctggtggaggctgctcgggcagtcgctgatggggatttcgctacagcgtatggattccttgatgtcttggaacagatggtgtcagtctcaggcagtccgatccaacggctaggctcttacatggcagaagggcttagagcgaggcttgaggggtctgggagcaatatatacaaatccttgaaatgcaatgaaccaacgggaagggaactgatgtcttacatgagtgttctctatgaaatctgcccctactggaaattcgcgatcacaactgcgaatgttgagatcttggaagcaatagctggggaaaccagagtccacattatcgattttcagattgcacagggatcacaatacatgtttttgattcaggagcttgcgaaacaccctggtgggccgccgttgctgcgtgtgacgggtgtggatgattcacagtccacctatgctcgtgggggaggactcagcttggtaggtgagaggcttgcaactttggcgcagtcatgtggtgtcccgtttgagtttcacgatgccatcatgtctgggtgcaaggtgcagcgggaacatctcgggttggaacctggctttgctgttgttgtgaacttcccatatgtattacaccacatgccagacgagagcgtaagtgttgaaaatcacagagacaggctgctgcatatgatcaagagcctctccccaaaactggttactctagtagagcaagaatccaacacaaacacctcgccattcctgtcacggtttgtggaaacactggattactacacagcgatgtttgagtcgatagatgcagcacggccacgggatgataagcagagaatcagcgcagaacaacactgtgtagcaagagacatagtgaacatgatagcatgtgaggagtcagagagagtagagagacacgaggtactgggaaatggagggtcagaatga

SEQ ID NO: 443 - protein, 375 aa, Arabidopsis thaliana
  G313 Amino Acid Sequence
MEATVKIFYYGTGVKSKIRELEVSLLSGDTKVEEFSGFSPAAGKSWNWDELLALTPQLDLKEVLVEAARAVADGDFATAYGFLDVLEQMVSVSGSPIQRLGSYMAEGLRARLEGSGSNIYKSLKCNEPTGRELMSYMSVLYEICPYWKFAITTANVEILEAIAGETRVHIIDFQIAQGSQYMFLIQELAKHPGGPPLLRVTGVDDSQSTYARGGGLSLVGERLATLAQSCGVPFEFHDAIMSGCKVQREHLGLEPGFAVVVNFPYVLHHMPDESVSVENHRDRLLHMIKSLSPKLVTLVEQESNTNTSPFLSRFVETLDYYTAMFESIDAARPRDDKQRISAEQHCVARDIVNMIACEESERVERHEVLGNGGSE

SEQ ID NO: 444 - DNA, 2774 bp, Arabidopsis thaliana
  G313 Genomic Sequence
tcattctgaccctccatttcccagtacctcgtgtctctctactctctctgactcctcacatgctatcatgttcactatgtctcttgctacacagtgttgttctgcgctgattctctgcttatcatcccgtggccgtgctgcatctatcgactcaaacatcgctgtgtagtaatccagtgtttccacaaaccgtgacaggaatggcgaggtgtttgtgttggattcttgctctactagagtaaccagttttggggagaggctcttgatcagatgcagcagcctgtctctgtgattttcaacacttacgctctcgtctggcatgtggtgtaatacatatgggaagttcacaacaacagcaaagccaggttccaacccgagatgttcccgctgcaccttgcacccagacatgatggcatcgtgaaactcaaacgggacaccacatgactgcgccaaagttgcaagcctctcacctaccaagctgagtcctcccccacgagcataggtggactgtgaatcatccacacccgtcacacgcagcaacggcggcccaccagggtgtttcgcaagctcctgaatcaaaaacatgtattgtgatccctgtgcaatctgaaaatcgataatgtggactctggtttccccagctattgcttccaagatctcaacattcgcagttgtgtacgcgaatttccagtaggggcagatttcatagagaacactcatgtaagacatcagttcccttcccgttggttcattgcatttcaaggatttgtatatattgctcccagacccctcaagcctcgctctaagcccttctgccatgtaagtgcctagccgttggatcggactgcctgagactgacaccatctgttccaagacatcaaggaatccatacgctgtagcgaaatccccatcagcgactgcccgagcagcctccaccagcacctctttcaagtccaactgtggagtcaaagccaaaagttcatcccagttccacgacttcccagcagcggggctaaaacctgagaattcttcaacttttgtatcaccactcagcagcgagacctcaagttcccgaatcttactcttgactccagcttcatcataggcaagagatgacaccccactcaaaggtgatccatagacgttgtcaggggaatgatggagatccgagatgcaagactgagagccctgaggagaaacgggctccggccagatgtaatgctcacagaaggagagtcatacgaaggaagactaccagaagcagtggaggattcgagggtaaaaaagttttctttggacgggatatcagagaagcctttgttgtctttcgcttgaaactgaggtgaacagtagacttgaggatacagcatgtgcagtccagccgcactgtgatgtttctgagacgtttgcattggaaaaaccccagcaatacactacacagctcctgaatcaatcttcttttagccaaatcactctctacagtgtaacttgttcaaaccaaggagaataaaaacctgcctccatgaaaacatccaaaaacaacaagtgagctacaacagagtaaagcaactaaatacagacactgtgatttgtgatagaagaagaaaaaaaaggtctagttgtgaatttttctctaaacaaactcaaacatatgcgacaaagtctgctctcacaatcaatcactcaagtcatcatagggttatcagaaaacagatctgacatctttcagaaatcatatatcggtttttgctactgccttcagatttctattgccagataaaaggaaccccaaaaaatggaagctttacactctctatatatctctctctacagaagaaattacatctattcgaaggttggagtcataccctaaagcagggttttttaccagaatcaggttaaactaagggatttcaaagctttaaaacctaggctccaagtcaagatttttacacaatcatcaggataaagtttagtacttttgaatcaacacaaggcaaacaaagggacaggtagacaaatcgatgttgggttacagggaataatcgctttttgcgccaaaaccaaatcaaacaagtcatatcctttcaaaaacaaacaatcaaaaaaggcacatataagctcagattcctaacccctaggaccaaaagcttaaaaccagatgagagcagagctaaggaagaagcaattgttcaatttagaaacaaatgaaattgaatcgttttgacaagaaaataaaaaggagaaagtgactacagagatcaccatgaaagctaaccttttgaaggagagaagctgaagaaattttgttgaatgggagatttttgttgacaaggggacaaaagagaagttttccttgcatactcaagaatcagcttgaggaagaagaaggagattgagatataataaaagtgcaaattgtcatgactctcttggagctaataaaatgcccccatttatgtggattatttacttgaatgccactctgaccattgacttttggacggcagtagctgcactaccactgtttatttattaattactctgttaacgtctaattgcttaccattaatgaaatgcttaagtagagtaatcataatgtgaagttttgccgaaatagcgtgtggacataaaacttattaacttagggtagactaatatactcttgtaatgtgttttctactcttgtcgctttcgttttttttatttactaaagaaaatacatttttaaaaaatttacttccataatagaatattttgactgtggcttccat

SEQ ID NO: 445 - DNA, 2774 bp, Arabidopsis thaliana; identical to SEQ ID NO: 444
  G313 DNA sequence used for BLAST

SEQ ID NO: 446 - DNA, 1380 bp, Arabidopsis thaliana
  G315 cDNA Sequence
atggacgaacatgtcatgcgttcaatggattgggattccatcatgaaagaattggagcttgatgacgattctgctcctaactcacttaaaaccggtttcaccacaaccacaacagattctactattttgcctctttacgccgtcgattcaaatctccctggctttcccgatcagattcaaccgtcggatttcgaatcgtcttccgatgtttatcctggtcagaaccaaacaactgggtacggttttaattctcttgatagtgtcgacaatggaggatttgatttcattgaagatctcatccgagtcgtggattgtgttgaatcggacgagttacaactcgctcaggtggttttatcacggcttaatcaacgcttgagatctccggcgggtagaccgttacagagagctgcgttttactttaaggaagctctcggttcgtttttaaccggatcaaaccggaatccaatccggttatcttcttggtccgagattgttcagaggatccgagcgattaaggaatattccgggatttctccgatccctctcttctctcatttcacggcgaatcaagcgatactcgattcgttgagctcgcagtcgtcttctccgtttgttcacgtggtggattttgagattggattcggtggccaatacgcatcgcttatgagagaaatcactgagaaatctgtaagcggtggatttttaagagttacggcagtggtggcggaggagtgcgccgtagagacgcgactagtgaaagaaaacctaactcaattcgcggcggagatgaaaattcgtttccagattgagtttgtgctgatgaagacttttgagatgttatctttcaaagcgattaggtttgttgagggggagaggaccgtcgttttgatttccccggcgatatttcgtcgtctaagtggaatcactgattttgttaacaatttacggagagtatcacctaaggtcgttgtattcgtggatagtgaaggatggacggagatcgccggatctggatcattccggcgagagtttgttagcgctcttgagttctacacgatggtgctggagtcgctcgacgctgcagctcctcccggagatttggtgaagaagatagtggaagcgttcgttctacgaccgaagatctccgctgcggtagaaacggcggctgacaggagacacaccggcgaaatgacttggcgggaagcgttttgcgccgccgggatgaggccgatacagcaaagccagttcgccgactttcaagctgagtgtttattggagaaagcgcaagttagaggattccacgtggcgaaacgacaaggagaattggtgctgtgctggcatggaagagcacttgttgccacatcagcttggcggttttag

SEQ ID NO: 447 - protein, 459 aa, Arabidopsis thaliana
  G315 Amino Acid Sequence
MDEHVMRSMDWDSIMKELELDDDSAPNSLKTGFTTTTTDSTILPLYAVDSNLPGFPDQIQPSDFESSSDVYPGQNQTTGYGFNSLDSVDNGGFDFIEDLIRVVDCVESDELQLAQVVLSRLNQRLRSPAGRPLQRAAFYFKEALGSFLTGSNRNPIRLSSWSEIVQRIRAIKEYSGISPIPLFSHFTANQAILDSLSSQSSSPFVHVVDFEIGFGGQYASLMREITEKSVSGGFLRVTAVVAEECAVETRLVKENLTQFAAEMKIRFQIEFVLMKTFEMLSFKAIRFVEGERTVVLISPAIFRRLSGITDFVNNLRRVSPKVVVFVDSEGWTEIAGSGSFRREFVSALEFYTMVLESLDAAAPPGDLVKKIVEAFVLRPKISAAVETAADRRHTGEMTWREAFCAAGMRPIQQSQFADFQAECLLEKAQVRGFHVAKRQGELVLCWHGRALVATSAWRF

SEQ ID NO: 448 - DNA, 1380 bp, Arabidopsis thaliana; identical to SEQ ID NO: 446
  G315 Genomic Sequence

SEQ ID NO: 449 - DNA, 1380 bp, Arabidopsis thaliana
  G315 DNA sequence used for BLAST
ctaaaaccgccaagctgatgtggcaacaagtgctcttccatgccagcacagcaccaattctccttgtcgtttcgccacgtggaatcctctaacttgcgctttctccaataaacactcagcttgaaagtcggcgaactggctttgctgtatcggcctcatcccggcggcgcaaaacgcttcccgccaagtcatttcgccggtgtgtctcctgtcagccgccgtttctaccgcagcggagatcttcggtcgtagaacgaacgcttccactatcttcttcaccaaatctccgggaggagctgcagcgtcgagcgactccagcaccatcgtgtagaactcaagagcgctaacaaactctcgccggaatgatccagatccggcgatctccgtccatccttcactatccacgaatacaacgaccttaggtgatactctccgtaaattgttaacaaaatcagtgattccacttagacgacgaaatatcgccggggaaatcaaaacgacggtcctctccccctcaacaaacctaatcgctttgaaagataacatctcaaaagtcttcatcagcacaaactcaatctggaaacgaattttcatctccgccgcgaattgagttaggttttctttcactagtcgcgtctctacggcgcactcctccgccaccactgccgtaactcttaaaaatccaccgcttacagatttctcagtgatttctctcataagcgatgcgtattggccaccgaatccaatctcaaaatccaccacgtgaacaaacggagaagacgactgcgagctcaacgaatcgagtatcgcttgattcgccgtgaaatgagagaagagagggatcggagaaatcccggaatattccttaatcgctcggatcctctgaacaatctcggaccaagaagataaccggattggattccggtttgatccggttaaaaacgaaccgagagcttccttaaagtaaaacgcagctctctgtaacggtctacccgccggagatctcaagcgttgattaagccgtgataaaaccacctgagcgagttgtaactcgtccgattcaacacaatccacgactcggatgagatcttcaatgaaatcaaatcctccattgtcgacactatcaagagaattaaaaccgtacccagttgtttggttctgaccaggataaacatcggaagacgattcgaaatccgacggttgaatctgatcgggaaagccagggagatttgaatcgacggcgtaaagaggcaaaatagtagaatctgttgtggttgtggtgaaaccggttttaagtgagttaggagcagaatcgtcatcaagctccaattctttcatgatggaatcccaatccattgaacgcatgacatgttcgtccat

SEQ ID NO: 450 - DNA, 756 bp, Arabidopsis thaliana
  G321 cDNA Sequence
atgtattatcagttgaccaagtcttcttacagagactctttgaagattctggaggctgatattgagcacgccaatggactggctgctgagattccaatgggaaagagcggtgtgcgacttcagatgaaattggtgtgcagcaatttggctccattcttcatattcctgctacaatggatggatttctcatgtctgcttccaagatattttgatttcttccacatactcatatacaaggtacgtgctgatgggcggtggaatcgatctaggtacggaaggaaagctacgattagggagttttacggtgttatattaccatcacttgagcgacttcatatcaactttgctgacttaccggacgaaagcttgtggtatccgaatccaaaagccatcaccaagaagcagtatgacattgaaggtagcagatacatgaatagcattgacttggaaagagaagacgaatgcgggatttgcttagagccttgcaccaaaatggtgttgccaaactgttgtcatgccatgtgcatcaaatgttaccgtaactggaacacaaagtcggagtcatgcccgttttgtcgtggcagcatcaagagagtgaactcagaggatctgtgggtgctaacttgcgatgaagatgtggtggatccagagacggtcaccaaagaggatcttcttcggttctacctccacatcaatagccttcctaaggattatccagaagcggccttcttagtctacaacgagtacttgatatga

SEQ ID NO: 451 - protein, 251 aa, Arabidopsis thaliana
  G321 Amino Acid Sequence
MYYQLTKSSYRDSLKILEADIEHANGLAAEIPMGKSGVRLQMKLVCSNLAPFFIFLLQWMDFSCLLPRYFDFFHILIYKVRADGRWNRSRYGRKATIREFYGVILPSLERLHINFADLPDESLWYPNPKAITKKQYDIEGSRYMNSIDLEREDECGICLEPCTKMVLPNCCHAMCIKCYRNWNTKSESCPFCRGSIKRVNSEDLWVLTCDEDVVDPETVTKEDLLRFYLHINSLPKDYPEAAFLVYNEYLI

SEQ ID NO: 452 - DNA, 1438 bp, Arabidopsis thaliana
  G321 DNA sequence used for BLAST
tcatatcaagtactcgttgtagactaagaaggccgcttctggataatccttaggaaggctattgatgtggaggtagaaccgaagaagatcctctttggtgaccgtctctggatccaccacatcttcatcgcaagttagcacccacagatcctctgagttcactctcttgatgctgccacgacaaaacgggcatgactccgactttgtgttccagttacggtaacatttgatgcacatggcatgacaacagtttggcaacaccattttggtgcaaggctctaagcaaatcccgcattcgtcttctctttccaagtcaatgctattcatgtatctgctaccttcaatgtcatactgcttcttggtgatggcttttggattcggataccacaagctttcgtccggtaagtcagcaaagttgatatgaagtcgctcaagtgatggtaatataacacctgcatttagccagagccatagttataagattaagcccacagtagaagaaacacaatcacaattaagagcttagtcttaccgtaaaactccctaatcgtagctttccttccgtacctagatcgattccaccgcccatcagcacgtacctgtacaagacaaagaagacacctataaaacaaacaagccaagaggaaaggagagaaactatcagggaatctaccatttcacacacacacacacacaactcgatatctatgtatgcggtaacaaccttgtatatgagtatgtggaagaaatcaaaatatcttggaagcagacatgagaaatccatccattgtagcaggaatatgaagaatggagccaaattgctgcacaccaatttcatctgaagtcgcacaccgctctttcccattggaatctcagcagccctgaatcaaatttgagagtaatcagtcattacactaatccttctaacataacccatcccttcagacaacatatgcctgaagaacaaaccacacagataccaattctgagactaagcagttactatatccttcgaatcacataaaccatttccacagacaacatatgcatcaataccacaccacagatatacaaattgtgagactattcagttaccatccttctaatcacatttaacccatttcttcagacaacatatgcatcaagaccacaccacgcatgccacaaaatttagcaattttttgaccatttctgcaaagtttcgatttttaataatctaagttcgtgataacgaccgaaaatgtaaaattgtggggccctaaaccctaaatcatcgaagccaactataacaatcgatactaaagaccctaaacccagtaaaaatcaaagaacccagaaagaatcagaggatgactcacagtccattggcgtgctcaatatcagcctccagaatcttcaaagagtctctgtaagaagacttggtcaactgataatacat

SEQ ID NO: 453 - DNA, 684 bp, Arabidopsis thaliana
  G322 cDNA Sequence
atggtgaatggagaatcatcaactagtacgtcttactctgatagtaacaatgacacaaatgatcaaggaggagactttgaatgtaacatttgtttcgaactagctcaagatccgattgtcactctctgtggccatctcttttgctggccttgcttataccgttggcttcaccaccattcacattctcaagaatgtccggtttgtaaagccgtggttcaagacgataagcttgttcctctttacggtagaggcaagaaccagactgacccgagatcaaaacgttatccgggtttacggattcctaaccgaccaacaggtcaaagacctgagactgctgctcctcctcctcagcctgaagctgcgagtaattttttcaactacggtattggtttgatgggtggaattatgccgatgatggcgactacgaggtttgggaatttcagtatggggtttggtggtttgttaccttctttgtttaactttcagtttcatggatttcatgatgctacgctttatggttcaacaccgggttatccttacggtggttatcataacggtttccgtggagttcctcctcgtggacaagagcgtcctatggctcgtggaggaaaccaaagtgatgcatttctgaagaatatcctcttttttgttggaatctgtgtggtgatatttctcatctggtga

SEQ ID NO: 454 - protein, 227 aa, Arabidopsis thaliana
  G322 Amino Acid Sequence
MVNGESSTSTSYSDSNNDTNDQGGDFECNICFELAQDPIVTLCGHLFCWPCLYRWLHHHSHSQECPVCKAVVQDDKLVPLYGRGKNQTDPRSKRYPGLRIPNRPTGQRPETAAPPPQPEAASNFFNYGIGLMGGIMPMMATTRFGNFSMGFGGLLPSLFNFQFHGFHDATLYGSTPGYPYGGYHNGFRGVPPRGQERPMARGGNQSDAFLKNILFFVGICVVIFLIW

SEQ ID NO: 455 - DNA, 684 bp, Arabidopsis thaliana; identical to SEQ ID NO: 453
  G322 Genomic Sequence

SEQ ID NO: 456 - DNA, 684 bp, Arabidopsis thaliana
  G322 DNA sequence used for BLAST
tcaccagatgagaaatatcaccacacagattccaacaaaaaagaggatattcttcagaaatgcatcactttggtttcctccacgagccataggacgctcttgtccacgaggaggaactccacggaaaccgttatgataaccaccgtaaggataacccggtgttgaaccataaagcgtagcatcatgaaatccatgaaactgaaagttaaacaaagaaggtaacaaaccaccaaaccccatactgaaattcccaaacctcgtagtcgccatcatcggcataattccacccatcaaaccaataccgtagttgaaaaaattactcgcagcttcaggctgaggaggaggagcagcagtctcaggtctttgacctgttggtcggttaggaatccgtaaacccggataacgttttgatctcgggtcagtctggttcttgcctctaccgtaaagaggaacaagcttatcgtcttgaaccacggctttacaaaccggacattcttgagaatgtgaatggtggtgaagccaacggtataagcaaggccagcaaaagagatggccacagagagtgacaatcggatcttgagctagttcgaaacaaatgttacattcaaagtctcctccttgatcatttgtgtcattgttactatcagagtaagacgtactagttgatgattctccattcaccat

SEQ ID NO: 457 - DNA, 1558 bp, Arabidopsis thaliana
  G326 cDNA Sequence
caattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggagatatgataagaccataagatatgaaacgaggaaggcgagagccgagaccaggttgcgtgttaagggcagatttgtgaaagctacagatccttagatgtctctccacgttaggttttacatttgagatcctaagttaggaactttttttgttttttctactttcaactaccttgtaaatgtaaatgatcgatcttcagctgcataatgtgtggccagatttttgtaatttttacgtttaaccttctaaaaaaaaaaa

SEQ ID NO: 458 - protein, 401 aa, Arabidopsis thaliana
  G326 Amino Acid Sequence
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 459 - DNA, 1888 bp, Arabidopsis thaliana
  G326 Genomic Sequence
atgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcaggtccatttctctatctctctctggcaattgattttagggttttaagtttggtcatgtgttcttgcttttgtgcttagaacatgttacagtaacttcagttggatctttaggtctccaaatctgttaagttacctgtcggaacgttgattattctttcttggttgtcctaattagagataagactctgttttatggcctggggttcacagtggaatatacgttgttgcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggtattacattgttattaggtttggaattgtaaaccattttatttatctcacaaattgacaaacacaacgcacattgcagaacgtaattagagtttgttctatagacaataaactcccccgatccctaaattcaatcccaaaacactccataccttaaacatttgaatattccctcatatatagcttaagttggtgactgatatactggtctggtagtagctacatctcatgggtttatttctattggttagaacatcttggaatgaatgaaacctgatgtatttatatcataattgataagtcaaactactatttttggtatatctttgtcggtgaactgtgatacttataagtagaatgtagcaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggaggtaatgatgttctccattttttcttttagtttcccttttgtaagttgattgtctttcgaaatcgctaatttgtaattgcttcagcagatatgataagaccataagatatgaaacgaggaaggcgagagccgagaccaggttgcgtgttaagggcagatttgtgaaagctacagatccttag

SEQ ID NO: 460 - DNA, 1888 bp, Arabidopsis thaliana
  G326 DNA sequence used for BLAST
ctaaggatctgtagctttcacaaatctgcccttaacacgcaacctggtctcggctctcgccttcctcgtttcatatcttatggtcttatcatatctgctgaagcaattacaaattagcgatttcgaaagacaatcaacttacaaaagggaaactaaaagaaaaaatggagaacatcattacctccgcgttttcttcttttccttgtaccgctgcatagcattatctctgttctgtgccatctgctctagatcagcattcgttaccgccaccaatcttgtggctctattactagtaatagcaatatgttccgtgcaatgcaagccacaggagtcgttagaacttttatgcgagtgaatggcagcaggaatattgttgctcttagatgtttcctgtcccttggtagaagttgagtggacggaatcctcctgctacattctacttataagtatcacagttcaccgacaaagatataccaaaaatagtagtttgacttatcaattatgatataaatacatcaggtttcattcattccaagatgttctaaccaatagaaataaacccatgagatgtagctactaccagaccagtatatcagtcaccaacttaagctatatatgagggaatattcaaatgtttaaggtatggagtgttttgggattgaatttagggatcgggggagtttattgtctatagaacaaactctaattacgttctgcaatgtgcgttgtgtttgtcaatttgtgagataaataaaatggtttacaattccaaacctaataacaatgtaatacctggtaactctctttgaaagcattcatattggtggttcgggtatcgttcttgagatgagtaacgttgttgaatgtgaaagtagagcctttagtttcgactggactaggttcatcagggttcctcgactgtcccaagttaaaatcccatatctgcaacaacgtatattccactgtgaaccccaggccataaaacagagtcttatctctaattaggacaaccaagaaagaataatcaacgttccgacaggtaacttaacagatttggagacctaaagatccaactgaagttactgtaacatgttctaagcacaaaagcaagaacacatgaccaaacttaaaaccctaaaatcaattgccagagagagatagagaaatggacctgagtgttctggccagtgctatgattagtagcattccattgcataccattaccacaaagactttgagacataagcaaagaagtaaacgacgtcgtcggagatggctgagaaatgcttcctccgccattgattccctccggaaccataatctctccttcgccttcaacgaagcctctcttcagtaactcaagctgttcaaacactacctgcttagacctcccaaagctaaagctttgctttttgcaagacacatcataaggaacaatcagttcttgaacgatgttagatccagaaccccacgaatccaaccccatcccaaaattcttagtcaattcgtcttcgtcatcttctttcttcttaccctttaaatcgattccccacacagcagcaagctccaaaaccgaaggacaacctgaaaacccttccacggcggagcgttcatgcgtcgcggaggaggaacagcttccgtgaacatcccaatcacactcctgacacaatacgagattatctgtgaagcaacgtacggacaccggctctttgctacagttatcacagatctgagaacgaacatgcttcctcgagagaaggttcgccgagtgcacgtgctggtcacaaggcaaacaaagcttcgccgtatcggctctacaaaacagaaccgccgttctctcgccgcaaaattcacacgccaccacactctctgtagtagaagtacccat

SEQ ID NO: 461 - DNA, 1068 bp, Arabidopsis thaliana
  G328 cDNA Sequence
atgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctga

SEQ ID NO: 462 - protein, 355 aa, Arabidopsis thaliana
  G328 Amino Acid Sequence
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 463 - DNA, 1177 bp, Arabidopsis thaliana
  G328 DNA sequence used for BLAST
tcagaatgatggaacaattccatatccggtgtcaaatgttatcattgtggagaaagcttggtttgcctcttcatcgacatctttcttctttgcaaaccggcccttgatccgtggtcttttctctgcatacgctttccttgaagcatatcttatcgtcttctcaaatttcctcatcttcttcttctctctgtatctcaggactctagcttctctgtcccttggactgagcatctgagctggagggtaaggtggttggtctgttaccgctttgggcgatcttgggtttgatactgttgcgtcactcgttgttgactccggcacaactcccaggtccatagatgaaacattcacctaatgacagtaacaaagacattcttagaaatttacttcatggatttgtgtgaaagaagcagcatgctggtcatagtaacggatctgaattaaatatatgaaagcttaccatatgactgagggaaccattggagcttcgaagagctccccaggagccacagttgatactcagctgaaagttctgttgctcttggtacatgccctttgatacttcaatttgaagtggaacaactccatcttccccatagctcctctgaggtacgttgcagtctagttgatactgattggattgatctgtgaattgcttatcactcgaactataatcaacaaggttcagaaactcatccccaatcgagaagccattgttgttaccactgtttttccctgaattaggcaacaaccatgaagccgcctctgcttcatcttcatcctcttcttcttgaccaagcacaagtctgttctctggatctgtcactgttgtctcacatgaatggttagtggccgtggaactgtaagagtactcagaaatgggcagaattggaactcgttgatggcgtctagcaagtgggtttgcggaatgaatctctgaatcacaggttgtgcatagagatgcagcatctgccttgcagaaaaaggcagccggggctcgctcacatgattgacagactcgaacacgttcatggcgggaagcaagacgattggcagcatgaacttgagcatcacaactggagcacaagtaggcagaatcagcccggcagtacacggtgcaggcggctgatcggcatgtatcacaggcttgtgcccagttactctctactttcaacat

SEQ ID NO: 464 - DNA, 1033 bp, Arabidopsis thaliana
  G329 cDNA Sequence
tctgaacctacgcttctgctaagctattctaagagaagccagactagcaataaacccttcattttaagcattctgtttccttcttgagaaacctagatattttggtttcttgtatccggtgatgaagatacagtgtgatgtgtgtgagaaagctccggcgacggtgatttgttgcgccgacgaagctgctctctgtcctcaatgcgacatcgagattcacgccgctaacaaactcgctagcaagcaccaacgtcttcatcttaattccctctccaccaaattccctcgttgcgatatctgccaagagaaggcagctttcattttctgtgtagaggatagagctctgctttgcagggactgcgatgaatccatccacgtggctaattctcgatctgctaatcaccagaggttcttagccactgggatcaaagtagctctgacctcaactatatgtagtaaagaaattgagaagaatcaacctgagccttccaacaaccaacagaaggctaatcagattcctgctaaatccacaagccagcagcaacaacaaccttcttctgctactccacttccctgggctgttgacgatttctttcacttctctgatattgaatccaccgacaagaaaggacagcttgatcttggggcaggggagttggattggttttcagacatgggattcttcggtgatcagattaatgacaaggctcttcctgcagctgaagttcctgagctttctgtttcgcatttaggtcatgttcattcatacaaacctatgaagtcaaatgtttcacacaagaagccgaggtttgagaccagatatgatgatgatgatgaggaacacttcattgtccctgatcttggctaaaaagctatatgtaatctatgtgtagacattcttcaatgtaaaagaacaaacaagaaacctatctgcatgtgtggagttaatgtcatatacattttagttttgtcttaagttgtgtaagatatgttgagagcttataacaaatgtctgtgtttgagttaaaaaaaa

SEQ ID NO: 465 - protein, 248 aa, Arabidopsis thaliana
  G329 Amino Acid Sequence
MKIQCDVCEKAPATVICCADEAALCPQCDIEIHAANKLASKHQRLHLNSLSTKFPRCDICQEKAAFIFCVEDRALLCRDCDESIHVANSRSANHQRFLATGIKVALTSTICSKEIEKNQPEPSNNQQKANQIPAKSTSQQQQQPSSATPLPWAVDDFFHFSDIESTDKKGQLDLGAGELDWFSDMGFFGDQINDKALPAAEVPELSVSHLGHVHSYKPMKSNVSHKKPRFETRYDDDDEEHFIVPDLG

SEQ ID NO: 466 - DNA, 998 bp, Arabidopsis thaliana
  G329 DNA sequence used for BLAST
ttagccaagatcagggacaatgaagtgttcctcatcatcatcatcatatctggtctcaaacctcggcttcttgtgtgaaacatttgacttcataggtttgtatgaatgaacatgacctaaatgcgaaacagaaagctcaggaacttcagctgcaggaagagccttgtcattaatctgatcaccgaagaatcccatgtctgaaaaccaatccaactcccctgccccaagatcaagctgtcctttctgctcaatttaaaccaagaagtcaataaaagcttcttgcaaagaaagtgatctaacattgaatctcaattctcatcactaccttgtcggtggattcaatatcagagaagtgaaagaaatcgtcaacagcccagggaagtggagtagcagaagaaggttgttgttgctgctggcttgtggatttagcaggaatctgattagccttctgttggttgttggaaggctcaggttgattcttctcaatttctttactacatatagttgaggtcagagctactttgatcccagtggctaagaacctctggtgattagcagatcgagaattagccacgtggatggattcatcgcagtccctgcaaagcagagctctatcctctacacagaaaatgaaagctgccttctcctacaagtcataagaacataatgagcaaaccctagtcttaaacaacaaggcatacatacaacagttgctacaagatctataaaatcacaactttgcaacagagcagattcaaactaacgaatccataaaatatttgacaagatctaatgagatctgtagagaaacttacttggcagatatcgcaacgagggaatttggtggagagggaattaagatgaagacgttggtgcttgctagcgagtttgttagcggcgtgaatctcgatgtcgcattgaggacagagagcagcttcgtcggcgcaacaaatcaccgtcgccggagctttctcacacacatcacactgtatcttcat

SEQ ID NO: 467 - DNA, 1051 bp, Arabidopsis thaliana
  G330 cDNA Sequence
attttacccatttcctctctttgtacgaacaaagtgcttcgagtttttgttaacctttttctctgatctaatggcgatggaagatcaatcggcggcgagatctatcggaaaagttagttggtttagcgatggaaaaggctacggtttcattactcccgatgatggcggcgaagagctttttgttcatcaatcctcaattgtctccgatggattccgtagcttgactcttggtgaatcggttgaatacgaaatcgcgcttggaagcgacggaaagactaaggccattgaagttactgctcccggcggcggttcacttaataagaaggaaaacagctcccgtggatccggaggtaattgttttaattgcggtgaggttggtcatatggctaaggattgtgacggtggaagtggtgggaaaagctttggaggtggtggtggtcgtagatctggcggcgaaggtgaatgttacatgtgtggtgatgtgggacacttcgctagggattgtaggcaaagcggtggtggaaacagcggcggaggaggaggaggtggtcgtccgtgttacagttgcggtgaggttggtcatttggcaaaggattgtcgtggtggttctggtggaaacagatacggaggaggtggtggtcgtggatctggcggtgatggatgctacatgtgtggtggtgtgggacatttcgctagggattgtaggcaaaacggcggtggaaacgttggaggtggtggaagcacttgttatacctgtggcggagttggccacattgcgaaagtttgcaccagcaagataccttctggtggtggtggtggtggtcgtgcttgttacgaatgtggaggaactggccatttggctcgtgactgtgatcggagaggaagtggaagcagcggaggtggcggtggcagtaacaagtgcttcatctgcggcaaggaaggtcactttgcgagggaatgtacttcgattgctaaagtcgtttaggatgtttaagaatggttgttttgggagtttttgatctctctatattactcttttgactggtttaaa

SEQ ID NO: 468 - protein, 304 aa, Arabidopsis thaliana
  G330 Amino Acid Sequence
MAMEDQSAARSIGKVSWFSDGKGYGFITPDDGGEELFVHQSSIVSDGFRSLTLGESVEYEIALGSDGKTKAIEVTAPGGGSLNKKENSSRGSGGNCFNCGEVGHMAKDCDGGSGGKSFGGGGGRRSGGEGECYMCGDVGHFARDCRQSGGGNSGGGGGGGRPCYSCGEVGHLAKDCRGGSGGNRYGGGGGRGSGGDGCYMCGGVGHFARDCRQNGGGNVGGGGSTCYTCGGVGHIAKVCTSKIPSGGGGGGRACYECGGTGHLARDCDRRGSGSSGGGGGSNKCFICGKEGHFARECTSIAKVV

SEQ ID NO: 469 - DNA, 1017 bp, Arabidopsis thaliana
  G330 Genomic Sequence
atggcgatggaagatcaatcggcggcgagatctatcggaaaagttagttggtttagcgatggaaaaggctacggtttcattactcccgatgatggcggcgaagagctttttgttcatcaatcctcaattgtctccgatggattccgtagcttgactcttggtgaatcggttgaatacgaaatcgcgcttggaagcgacggaaagactaaggccattgaagttactgctcccggcggcggttcacttaataagaaggaaaacagctcccgtggatccggaggtaattgttttaattgcggtgaggttggtcatatggctaaggattgtgacggtggaagtggtgggaaaagctttggaggtggtggtggtcgtagatctggcggcgaaggtgaatgttacatgtgtggtgatgtgggacacttcgctagggattgtaggcaaagcggtggtggaaacagcggcggaggaggaggaggtggtcgtccgtgttacagttgcggtgaggttggtcatttggcaaaggattgtcgtggtggttctggtggaaacagatacggaggaggtggtggtcgtggatctggcggtgatggatgctacatgtgtggtggtgtgggacatttcgctagggattgtaggcaaaacggcggtggaaacgttggaggtggtggaagcacttgttatacctgtggcggagttggccacattgcgaaagtttgcaccagcaagataccttctggtggtggtggtggtggtcgtgcttgttacgaatgtggaggaactggccatttggctcgtgactgtgatcggagaggaagtggaagcagcggaggtggcggtggcagtaacaagtgcttcatctgcggcaaggaaggtcactttgcgagggaatgtacttcggttgcttaacaaaaagatgcaaagaagaagagtaatgttcataaacctcttttgttttctattaaaatctacctaatgctcctttttggtgactataatgtgattgctaaagtcgtttag

SEQ ID NO: 470 - DNA, 1017 bp, Arabidopsis thaliana
  G330 DNA sequence used for BLAST
ctaaacgactttagcaatcacattatagtcaccaaaaaggagcattaggtagattttaatagaaaacaaaagaggtttatgaacattactcttcttctttgcatctttttgttaagcaaccgaagtacattccctcgcaaagtgaccttccttgccgcagatgaagcacttgttactgccaccgccacctccgctgcttccacttcctctccgatcacagtcacgagccaaatggccagttcctccacattcgtaacaagcacgaccaccaccaccaccaccagaaggtatcttgctggtgcaaactttcgcaatgtggccaactccgccacaggtataacaagtgcttccaccacctccaacgtttccaccgccgttttgcctacaatccctagcgaaatgtcccacaccaccacacatgtagcatccatcaccgccagatccacgaccaccacctcctccgtatctgtttccaccagaaccaccacgacaatcctttgccaaatgaccaacctcaccgcaactgtaacacggacgaccacctcctcctcctccgccgctgtttccaccaccgctttgcctacaatccctagcgaagtgtcccacatcaccacacatgtaacattcaccttcgccgccagatctacgaccaccaccacctccaaagcttttcccaccacttccaccgtcacaatccttagccatatgaccaacctcaccgcaattaaaacaattacctccggatccacgggagctgttttccttcttattaagtgaaccgccgccgggagcagtaacttcaatggccttagtctttccgtcgcttccaagcgcgatttcgtattcaaccgattcaccaagagtcaagctacggaatccatcggagacaattgaggattgatgaacaaaaagctcttcgccgccatcatcgggagtaatgaaaccgtagccttttccatcgctaaaccaactaacttttccgatagatctcgccgccgattgatcttccatcgccat

SEQ ID NO: 471 - protein, 367 aa, Arabidopsis thaliana
  G335 Amino Acid Sequence
MSDELWNEIQNLELGQEDPALFIPHEAYVMVEATNRLSMIARPLNPRVQNLNSVVVALPRTWGLTNQVHGRILDATYVQFLFQNEIDLMMVQRKEPWLFNNWFVAATRWEVAPAHNFVTTIDLWVQIRGIPLPYVSEETVMEIAQDLGEVLMLDYHDTTSIQIAYIRVRVRFGITDRLRFFQRIVFDSGETATIRFQYERLRRICSSCFRFTHNRAYCPYRPRPLSIARERALFRDSVHRSSMNSQSQMTDSSFPIPQTPPPRISHPPLNHDEFVAAYPHLDSGRNDHIRCEGESSNFRQDLSSASNSITPRREPQYLTDRRHFEPGQSSRRHDVRDLRRGSERIGNLNQQNYVQRSGGILKPPKKR

SEQ ID NO: 472 - DNA, 1104 bp, Arabidopsis thaliana
  G335 Genomic Sequence
atgtcggatgagttgtggaatgagatacaaaacctagaattaggtcaagaagatccagccctttttatccctcatgaggcttatgtgatggtggaagctaccaatagacttagtatgatagctagacctctgaacccaagggtccagaacctcaattctgttgtggtagcattaccaagaacatggggtttaacaaatcaagttcatggcagaatacttgatgctacttatgttcagtttctttttcaaaatgaaattgatctaatgatggttcaacgcaaggagccttggctttttaacaattggtttgttgcagctactcgatgggaggtggcaccggctcataacttcgttactacaattgatctgtgggtgcagattcgtggaatccctctgccatatgtttctgaggagacggttatggagattgctcaagatctgggggaagttcttatgctagactaccatgatacaacatctattcagattgcttacatacgggtgagagtgcgctttggtattacggacaggctaaggttctttcagcgaattgtctttgactccggggaaactgcaacaataagatttcagtatgaacgtctccggagaatctgcagtagctgcttcagattcactcacaacagagcttattgtccataccgaccaagacctctcagcattgcaagggaaagagctctgtttagggatagtgtgcatcgttcctccatgaactctcagtctcagatgactgatagttcatttccaattccccagactccaccaccaagaatatcccacccaccactgaatcatgatgagtttgtagctgcttatcctcacttggactcaggtaggaatgaccacatcagatgtgagggagaatcaagcaatttcagacaagacttgtcttcagcttcaaactccataactccaagaagggaaccacaatacctaactgatagaagacactttgaacctggtcaatcctcaagaagacatgatgttcgggatttaagaagagggtcagagaggattgggaatctcaatcaacagaactatgtgcaaagatcaggagggatactgaaacctccgaagaaacgctaa

SEQ ID NO: 473 - DNA, 1104 bp, Arabidopsis thaliana; identical to SEQ ID NO: 472
  G335 DNA sequence used for BLAST

SEQ ID NO: 474 - DNA, 795 bp, Arabidopsis thaliana
  G343 cDNA Sequence
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttttag

SEQ ID NO: 475 - protein, 264 aa, Arabidopsis thaliana
  G343 Amino Acid Sequence
MDVYGLSSPDLLRIDDLLDFSNEDIFSASSSGGSTAATSSSSFPPPQNPSFHHHHLPSSADHHSFLHDICVPSDDAAHLEWLSQFVDDSFADFPANPLGGTMTSVKTETSFPGKPRSKRSRAPAPFAGTWSPMPLESEHQQLHSAAKFKPKKEQSGGGGGGGGRHQSSSSETTEGGGMRRCTHCASEKTPQWRTGPLGPKTLCNACGVRFKSGRLVPEYRPASSPTFVLTQHSNSHRKVMELRRQKEVMRQPQQVQLHHHHHPF

SEQ ID NO: 476 - DNA, 888 bp, Arabidopsis thaliana
  G343 DNA sequence used for BLAST
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccgtataatctctctccctctctctttctccaatcaaagtttcgactttgaaataaagattgtgttttgatttttgttgtattttttgtgtgcagagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttttag

SEQ ID NO: 477 - DNA, 917 bp, Arabidopsis thaliana
  G345 cDNA Sequence
gtatgtgttaaagagtgaatggagctgtggacagaagctagagccttaaaggcaagtctaagaggagaatctactatatctctcaaacatcaccaagtgattgtgtcggaagatttaagccgaacttcttccttgccggaagatttctccgttgagtgtttcctcgatttctcagaaggtcaaaaagaagaagaagaagaagttgtctctgtttcttcttcacaagagcaagaagaacaagaacatgattgtgtctttagttcacaaccttgcatctttgatcaacttccttctttgccggatgaagatgtggaagagcttgaatgggtatctcgtgttgtggatgattgttcatcaccagaagtttcacttctcttaacacaaacacataaaaccaaaccaagcttctcaagaattccggttaaaccaagaaccaaacggtctcggaacagtttaaccggtagtcgtgtttggccactcgtttcaaccaatcatcaacatgcagcaacagagcagttgaggaagaagaaacaagaaactgtccttgtgtttcaacgaagatgcagccattgtggcacaaacaacacaccacagtggagaaccggtccggtcggtccaaaaaccttatgtaatgcatgtggagtccggtttaagtctggtaggctctgcccggaatacagaccggcggatagtccgacgttctcgaatgagattcactcaaatcttcataggaaggttctggaattaagaaagagtaaagagttgggtgaagaaacaggtgaagctagtactaaatcagacccagtcaaatttggcagcaagtggtagataagacttaggtaaaacctactttttgtaacattatctgtagtgttgtaatttaacaacttgcttcttaacaaaaaaaaaaaaaaaaa

SEQ ID NO: 478 - protein, 269 aa, Arabidopsis thaliana
  G345 Amino Acid Sequence
MELWTEARALKASLRGESTISLKHHQVIVSEDLSRTSSLPEDFSVECFLDFSEGQKEEEEEVVSVSSSQEQEEQEHDCVFSSQPCIFDQLPSLPDEDVEELEWVSRVVDDCSSPEVSLLLTQTHKTKPSFSRIPVKPRTKRSRNSLTGSRVWPLVSTNHQHAATEQLRKKKQETVLVFQRRCSHCGTNNTPQWRTGPVGPKTLCNACGVRFKSGRLCPEYRPADSPTFSNEIHSNLHRKVLELRKSKELGEETGEASTKSDPVKFGSKW

SEQ ID NO: 479 - DNA, 911 bp, Arabidopsis thaliana
  G345 Genomic Sequence
atggagctgtggacagaagctagagccttaaaggcaagtctaagaggagaatctactatatctctcaaacatcaccaagtgattgtgtcggaagatttaagccgaacttcttccttgccggaagatttctccgttgagtgtttcctcgatttctcagaaggtcaaaaagaagaagaagaagaagttgtctctgtttcttcttcacaagagcaagaagaacaagaacatgattgtgtctttagttcacaaccttgcatctttgatcaacttccttctttgccggtaaatttctaaacttctttataccttttctttctcttcttataatcgaaagattttaagttatatttttcttgatttctttttttttgggatatttttaggatgaagatgtggaagagcttgaatgggtatctcgtgttgtggatgattgttcatcaccagaagtttcacttctcttaacacaaacacataaaaccaaaccaagcttctcaagaattccggttaaaccaagaaccaaacggtctcggaacagtttaaccggtagtcgtgtttggccactcgtttcaaccaatcatcaacatgcagcaacagagcagttgaggaagaagaaacaagaaactgtccttgtgtttcaacgaagatgcagccattgtggcacaaacaacacaccacagtggagaaccggtccggtcggtccaaaaaccttatgtaatgcatgtggagtccggtttaagtctggtaggctctgcccggaatacagaccggcggatagtccgacgttctcgaatgagattcactcaaatcttcataggaaggttctggaattaagaaagagtaaagagttgggtgaagaaacaggtgaagctagtactaaatcagacccagtcaaatttggcagcaagtggtag

SEQ ID NO: 480 - DNA, 911 bp, Arabidopsis thaliana; identical to SEQ ID NO: 479
  G345 DNA sequence used for BLAST

SEQ ID NO: 481 - DNA, 825 bp, Arabidopsis thaliana; identical to SEQ ID NO: 77
  G346 cDNA Sequence

SEQ ID NO: 482 - protein, 274 aa, Arabidopsis thaliana
  G346 Amino Acid Sequence
MEMESFMDDLLNFSVPEEEEDDDEHTQPPRNITRRKTGLRPTDSFGLFNTDDLGVVEEEDLEWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 483 - DNA, 1403 bp, Arabidopsis thaliana
  G346 DNA sequence used for BLAST
atggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttgtaagtcttcccaaaaaaaaataaaaaaaatcgcctacacatgtttgttattaaatggtccggtgtatagtagactcggccgagttgactcgccggttcacggcggttggggattgttgactcagccgggtcaaaagtttcgggtttcggaaaacgcgttttactttattgtgttattaaacgtgcacgtcataagtgggaacgtttcgccggttccttttttgtgttgttgttaaaagacgaagctaccctttgatttttaatcctttgggagatttgtttcgggagtttttggagggtatattcggaaattaaaccattttttagtgagggtcattgtttcgtgagctgttcgtcacatgatggtgagctaccacaataaatttcaaccatttcgaaaattatatatgtcacacctttaaatttgatttattatttgatactccccaattattattgaaatgacgtaactacccttccgtttttatttcacccacccactctttttatcggaaaacgagtacgagttgactcagtcgagttatggagtttgactcggtctaatttgtttgttgcagggagtggttgaagaagaggatttggaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaccaccaccactccaacaataatgagctgttgcgttggttttaaagcgccggctaaagcgagaagcaagcgtcgtcgtacaggacgccgtgatttacgagttttgtggacaggaaacgagcaaggaggaatacagaagaagaagacgatgactgtggcggcggctgcgttgattatgggaaggaagtgtcaacactgtggagcggagaagactccgcaatggagggcaggaccagcggggcctaagactctgtgtaacgcttgtggcgtgaggtataagtccgggaggctagttccggagtatcgtccagcgaacagtccaactttcacggcggagttacattcgaattctcaccggaagattgtagagatgaggaagcagtatcagtccggtgacggtgacggtgatcggaaagattgtggataa

SEQ ID NO: 484 - DNA, 537 bp, Arabidopsis thaliana
  G355 cDNA Sequence
atgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctttag

SEQ ID NO: 485 - protein, 178 aa, Arabidopsis thaliana
  G355 Amino Acid Sequence
MKRERSDFEESLKNIDIAKCLMILAQTSMVKQIGLNQHTESHTSNQFECKTCNKRFSSFQALGGHRASHKKPKLTVEQKDVKHLSNDYKGNHFHKCSICSQSFGTGQALGGHMRRHRSSMTVEPSFISPMIPSMPVLKRCGSSKRILSLDLNLTPLENDLEYIFGKTFVPKIDMKFVL

SEQ ID NO: 486 - DNA, 537 bp, Arabidopsis thaliana; identical to SEQ ID NO: 484
  G355 Genomic Sequence

SEQ ID NO: 487 - DNA, 537 bp, Arabidopsis thaliana; identical to SEQ ID NO: 484
  G355 DNA sequence used for BLAST

SEQ ID NO: 488 - DNA, 615 bp, Arabidopsis thaliana
  G357 cDNA Sequence
atgcagaacaaacacaaatgcaagctctgttccaagagtttctgtaatggcagagcacttggtggtcacatgaagtctcacttggtctcatctcagtcttcagctcggaagaaactaggtgactcggtctattcttcttcttcctcttcctccgatggtaaagcgctcgcctacgggttacgagagaacccgaggaagagtttccgggtctttaatccggatcctgagtcatccacaatttacaacagtgagacagagaccgaacctgaatccggagacccggttaagaaacgggtcagaggagatgtttcaaagaagaagaagaagaaggcaaagagtaagagagtgtttgagaactcgaagaagcaaaagacaattcacgagtcaccagaaccagcgagttctgtctctgatggttctcctgaacaagatttagctatgtgcttgatgatgctgtcaagagattcaagggagctcgagattaaactgaaaaaaccggaggaagagaggaagccggaaaaaagacatttccctgagctccgtcgctgtatgatagatctgaatcttcctccgccgcaagaagctgaagctgtcaccgtcgtttcagccatataa

SEQ ID NO: 489 - protein, 204 aa, Arabidopsis thaliana
  G357 Amino Acid Sequence
MQNKHKCKLCSKSFCNGRALGGHMKSHLVSSQSSARKKLGDSVYSSSSSSSDGKALAYGLRENPRKSFRVFNPDPESSTIYNSETETEPESGDPVKKRVRGDVSKKKKKKAKSKRVFENSKKQKTIHESPEPASSVSDGSPEQDLAMCLMMLSRDSRELEIKLKKPEEERKPEKRHFPELRRCMIDLNLPPPQEAEAVTVVSAI

SEQ ID NO: 490 - DNA, 615 bp, Arabidopsis thaliana
  G357 Genomic Sequence
ttatatggctgaaacgacggtgacagcttcagcttcttgcggcggaggaagattcagatctatcatacagcgacggagctcagggaaatgtcttttttccggcttcctctcttcctccggttttttcagtttaatctcgagctcccttgaatctcttgacagcatcatcaagcacatagctaaatcttgttcaggagaaccatcagagacagaactcgctggttctggtgactcgtgaattgtcttttgcttcttcgagttctcaaacactctcttactctttgccttcttcttcttcttctttgaaacatctcctctgacccgtttcttaaccgggtctccggattcaggttcggtctctgtctcactgttgtaaattgtggatgactcaggatccggattaaagacccggaaactcttcctcgggttctctcgtaacccgtaggcgagcgctttaccatcggaggaagaggaagaagaagaatagaccgagtcacctagtttcttccgagctgaagactgagatgagaccaagtgagacttcatgtgaccaccaagtgctctgccattacagaaactcttggaacagagcttgcatttgtgtttgttctgcat

SEQ ID NO: 491 - DNA, 615 bp, Arabidopsis thaliana; identical to SEQ ID NO: 490
  G357 DNA sequence used for BLAST

SEQ ID NO: 492 - DNA, 922 bp, Arabidopsis thaliana; identical to SEQ ID NO: 93
  G361 cDNA Sequence

SEQ ID NO: 493 - protein, 197 aa, Arabidopsis thaliana
  G361 Amino Acid Sequence
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 494 - DNA, 594 bp, Arabidopsis thaliana
  G361 Genomic Sequence
atggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatga

SEQ ID NO: 495 - DNA, 594 bp, Arabidopsis thaliana; identical to SEQ ID NO: 494
  G361 DNA sequence used for BLAST

SEQ ID NO: 496 - DNA, 780 bp, Arabidopsis thaliana
  G363 cDNA Sequence
atgagaccaatattagacctcgaaattgaagcttcatcgggcagtagtagcagccaagtggcctcaaacttgtctccggttggggaagattacaaaccaatctcgctgaatcttagcctcagtttcaacaacaacaacaacaataatctggatcttgaatcatcgtctttgacgctgccactttcgagcacgagtgagagtagtaacccggagcagcagcagcaacaacaaccatctgtatcaaagagagtcttctcttgtaactactgccaaaggaagttctatagctctcaagcgctaggtggtcaccaaaacgctcacaaacgtgagagaacactcgccaaacgcgctatgctatgggtcttgctggggtcttccccggtagaggatcaagtagcaattatgcggctgctgccacagcagccgctctcgtgtttgccgcttcacggaagcggaaacgggaacatgacatcgttcaggactttgggaatccgggcacattcctcggcgcacgacgtcagcatgacaaggcagacaccagaaacacttattagaaacattgccaggttcaaccaggggtatttcggtaattgtatacctttttacgtggaggacgacgaggccgagatgctctggccggggagtttccggcaagctacgaatgcggttgcggttgaagcgggtaatgataatttaggtgaaagaaaaatggatttcttggacgtcaagcaagcgatggatatggaaagttctcttccagatctaaccttgaagctttga

SEQ ID NO: 497 - protein, 259 aa, Arabidopsis thaliana
  G363 Amino Acid Sequence
MRPILDLEIEASSGSSSSQVASNLSPVGEDYKPISLNLSLSFNNNNNNNLDLESSSLTLPLSSTSESSNPEQQQQQQPSVSKRVFSCNYCQRKFYSSQALGGHQNAHKRERTLAKRAMLWVLLGSSPVEDQVAIMRLLPQQPLSCLPLHGSGNGNMTSFRTLGIRAHSSAHDVSMTRQTPETLIRNIARFNQGYFGNCIPFYVEDDEAEMLWPGSFRQATNAVAVEAGNDNLGERKMDFLDVKQAMDMESSLPDLTLKL

SEQ ID NO: 498 - DNA, 780 bp, Arabidopsis thaliana; identical to SEQ ID NO: 496
  G363 Genomic Sequence

SEQ ID NO: 499 - DNA, 2088 bp, Arabidopsis thaliana
  G363 DNA sequence used for BLAST
agcataattaacttaatatttagtttacaatacataaacgtttaaatggtttatccacgtaagcaaacactagaattgacttttggtcgatcaatcgatagtgaccataacatatcagaaatggtttgtgaaactctcactgtacataatagagttatgaagctgatgcaccaaattaagaatccaaattcagcaaaaaaaaaaacaaaaaaaacgaaagctcaaagcttcaaggttagatctggaagagaactttccatatccatcgcttgcttgacgtccaagaaatccatttttctttcacctaaattatcattacccgcttcaaccgcaaccgcattcgtagcttgccggaaactccccggccagagcatctcggcctcgtcgtcctccacgtaaaaaggtatacaattaccgaaatacccctggttgaacctggcaatgtttctaataagtgtttctggtgtctgccttgtcatgctgacgtcgtgcgccgaggaatgtgcccggattcccaaagtcctgaacgatgtcatgttcccgtttccgcttccgtgaagcggcaaacacgagagagcggctgctgtggcagcagccgcataattgctacttgatcctctaccggggaagaccccagcaagacccatacgcatagcgcgtttggcgagtgttctctcacgtttgtgagcgttttggtgaccacctagcgcttgagagctatagaacttcctttggcagtagttacaagagaagactctctttgatacagatggttgttgttgctgctgctgctccgggttactactctcactcgtgctcgaaagtggcagcgtcaaagacgatgattcaagatccagattattgttgttgttgttgttgaaactgaggctaagattcagcgagattggtttgtaatcttccccaaccggagacaagtttgaggccacttggctgctactactgcccgatgaagcttcaatttcgaggtctaatattggtctcatgatttatggcagaaactttacgttgttttttctttttctgcaatgattttgtattgaagggaatgttaaaattattttgatcaaaaggaataatttaaagaaattggattgtttctgtccaaacaaagtcgataatgcatacaaaatattctaacaaaaataataattatttcagaaatagatagtggaggaaacattggtgtgaccataaatggtcctaacgagtcaatgagtagacaacatcagaagtgccaaatttagtactgacacatccatccatatatcaaccagtcaactctaactaattacattcttctatttctcactaaactaaacttaaatagtttccaaataatttctagattcttttatcatctagcaactaagtttaatttctattgagacagaaataacacaaaactttagatcacaaaaattgtaattcagttacttggttttgctttcattaacaatgagaacccaacaaagaaaaaaacataaatatacacaaagcgacaaacaaacaaaaaacccgacaaataaaacacatatactcaaaggaataaacaaaaaacagacaaacatatatagcgaaaagatcaccgacagcaaaatcaacttacttacgaagcagatccatcaactaaacaattatcatctccaaggaaatatatttatttatttaatttttagggtatccaatgtttttgagcaaaacgaaaaagaggtaaaaaagaaaaagttgaaacttaagttgctgacacataaatggcaataatatatgtgacccattcatatctaatttaaaagttatacaaccatgctaacaattgttgatcaaacatcataacttcaaatattgagaaagaattgtcaattaatccaagaacatagaaattgagagtcttagatttccaaagaaaaccaataaagaaagatgaaagaatattcataccttatatagttaggatgatgaagagaccaaggcttgggatttgagagaagaagtgggagttatgaacagatttgagtccatcgatctcgaggttattttggggacttaaaaagaaagagaagaagtgag

SEQ ID NO: 500 - DNA, 728 bp, Arabidopsis thaliana
  G364 cDNA Sequence
aagcttgatatcgcctctctctaatctctctttctctctctatctctaagaatatataaaggtatggactaccagccaaacacatccctacgtctaagcctaccaagttacaagaaccaccaactaaacctagaacttgttctcgagccttcttccatgtcttcttcttcatcttcttccacgaactcatcatcatgtttggagcagcctagggtattctcatgtaactattgtcaaagaaagttttacagctctcaagctcttggtggtcatcaaaacgctcataagcttgagagaaccttagccaagaagagtcgagaactctttagatcctcaaacactgttgattctgatcagccttacccgttctccggtcgctttgagctttacggccgtggctaccaaggatttctcgaaagtggcggctcgagggacttctccgcccgccgtgtgccggagagtggtcttgatcaggatcaggagaagagtcaccttgacttatccttaaggctctaaaagaatcttatattttgttagtctatatattatcatatcaattgttaatcttaaaattgattgttttacttattagtcatttcctattatctgaaagttttctttgtaagttgtaactatggtcctaaattcaaatccaaatttgattttggaagatggtacctaatgcagtagttaaataagttaaaaaaatgaaggatctataattctct

SEQ ID NO: 501 - protein, 150 aa, Arabidopsis thaliana
  G364 Amino Acid Sequence
MDYQPNTSLRLSLPSYKNHQLNLELVLEPSSMSSSSSSSTNSSSCLEQPRVFSCNYCQRKFYSSQALGGHQNAHKLERTLAKKSRELFRSSNTVDSDQPYPFSGRFELYGRGYQGFLESGGSRDFSARRVPESGLDQDQEKSHLDLSLRL

SEQ ID NO: 502 - DNA, 453 bp, Arabidopsis thaliana
  G364 Genomic Sequence
atggactaccagccaaacacatccctacgtctaagcctaccaagttacaagaaccaccaactaaacctagaacttgttctcgagccttcttccatgtcttcttcttcatcttcttccacgaactcatcatcatgtttggagcagcctagggtattctcatgtaactattgtcaaagaaagttttacagctctcaagctcttggtggtcatcaaaacgctcataagcttgagagaaccttagccaagaagagtcgagaactctttagatcctcaaacactgttgattctgatcagccttacccgttctccggtcgctttgagctttacggccgtggctaccaaggatttctcgaaagtggcggctcgagggacttctccgcccgccgtgtgccggagagtggtcttgatcaggatcaggagaagagtcaccttgacttatccttaaggctctaa

SEQ ID NO: 503 - DNA, 453 bp, Arabidopsis thaliana; identical to SEQ ID NO: 502
  G364 DNA sequence used for BLAST

SEQ ID NO: 504 - DNA, 1032 bp, Arabidopsis thaliana
  G368 cDNA Sequence
gttgcgtttccacatttgtttaaacataactctctctctctctctctctctctctctctctcagtacctcttattcttatgctcttcttcaccaatcctatctcttctatctgtctttattttctctacatgtgaattgacccatttctggtaaacacatagagtaccacttttcttatttagattcttcttcctcttcatagcttccaagtcaactacttcagcttctgtcggctgtctcttcccagatctcgttaagaccaaaacttggaataaatgacggaatctgatgatgcctcacgagaaacaccagccagcagaggaggagaagcctcgtcaaatcaagatctgtccaaaccagaatcaaaccatgtttcactcgatctcaagctcaacgatactttcaacgatgacacaaagagcacaaagtgtgaagcaaacccaagagtcttctcttgcaactactgcagacgcaagttctatagctctcaagctcttggaggtcaccagaacgcacacaagcgagaaagaacaatggccaaacgagcaatgcacatgggaagaatgtttggtcaccatcacaggccttacacatacacttcttcttcccttgggatgcaagctcactccggtttacttcatcacaccttatctcagcctcagcctcttgtttctaggtttcatcatcaagggtattttggtaacaccgtgccgttgttctttgactatgacgatggtggtagcgacttcttctggcccggcagcttccgtcaggtggttgaggaagctgaggctccggtggttgtggtggctagtactgagtcaggccttgatttgaactcggttgcggcaaatggaggtgtagataataatagctcaaagcctgatcttaccttaagactctaaaaggattaaggagattatatctttattgttatttttctattgttagacattcagaagataagttggagacagttgatagaaattgatgaaaaactttgttgttatattaaatgaggttgttcatta

SEQ ID NO: 505 - protein, 209 aa, Arabidopsis thaliana
  G368 Amino Acid Sequence
MTESDDASRETPASRGGEASSNQDLSKPESNHVSLDLKLNDTFNDDTKSTKCEANPRVFSCNYCRRKFYSSQALGGHQNAHKRERTMAKRAMHMGRMFGHHHRPYTYTSSSLGMQAHSGLLHHTLSQPQPLVSRFHHQGYFGNTVPLFFDYDDGGSDFFWPGSFRQVVEEAEAPVVVVASTESGLDLNSVAANGGVDNNSSKPDLTLRL

SEQ ID NO: 506 - DNA, 630 bp, Arabidopsis thaliana
  G368 Genomic Sequence
atgacggaatctgatgatgcctcacgagaaacaccagccagcagaggaggagaagcctcgtcaaatcaagatctgtccaaaccagaatcaaaccatgtttcactcgatctcaagctcaacgatactttcaacgatgacacaaagagcacaaagtgtgaagcaaacccaagagtcttctcttgcaactactgcagacgcaagttctatagctctcaagctcttggaggtcaccagaacgcacacaagcgagaaagaacaatggccaaacgagcaatgcacatgggaagaatgtttggtcaccatcacaggccttacacatacacttcttcttcccttgggatgcaagctcactccggtttacttcatcacaccttatctcagcctcagcctcttgtttctaggtttcatcatcaagggtattttggtaacaccgtgccgttgttctttgactatgacgatggtggtagcgacttcttctggcccggcagcttccgtcaggtggttgaggaagctgaggctccggtggttgtggtggctagtactgagtcaggccttgatttgaactcggttgcggcaaatggaggtgtagataataatagctcaaagcctgatcttaccttaagactctaa

SEQ ID NO: 507 - DNA, 630 bp, Arabidopsis thaliana; identical to SEQ ID NO: 506
  G368 DNA sequence used for BLAST

SEQ ID NO: 508 - DNA, 582 bp, Arabidopsis thaliana
  G371 cDNA Sequence
atggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaa

SEQ ID NO: 509 - protein, 193 aa, Arabidopsis thaliana
  G371 Amino Acid Sequence
MEIEKDEDDTTLVDSGGDFDCNICLDQVRDPVVTLCGHLFCWPCIHKWTYASNNSRQRVDQYDHKREPPKCPVCKSDVSEATLVPIYGRGQKAPQSGSNVPSRPTGPVYDLRGVGQRLGEGESQRYMYRMPDPVMGVVCEMVYRRLFGESSSNMAPYRDMNVRSRRRAMQAEESLSRVYLFLLCFMFMCLFLF

SEQ ID NO: 510 - DNA, 582 bp, Arabidopsis thaliana; identical to SEQ ID NO: 508
  G371 DNA sequence used for BLAST

SEQ ID NO: 511 - DNA, 1302 bp, Arabidopsis thaliana
  G376 cDNA Sequence
atgggccaaatgggctactcttgtatcgggtcaggaacggaatcgatcgatattgaaggagagaagatgcctggtttaacatgtaacgcgtgtaacatggagttcaaggacgaagaagaacgtaaccttcattacaaatccgattggcaccgctacaatctcaagcgcaaggtggctggagttcctggagttacagaagccttgtttgaggctagacaatctgctcttgctcaggagaagaataaatcaaatgaagcacctatgctttatacttgtgcaatctgtgctaaaggttacaggagttccaaggctcatgagcagcatcttcagtcgcgtagccatgttttgcgggtttcacaagggacatcaatcaacggagaggaggatatagcgattatcaggcaacttcctcgccgtgttcaacacaggggttccattgatgatgatagtgaagatgaatgggtggaggttgattctgacgaggaattggctgctgaagaagcctctgattctttgtctaagttgaatgtgaatgagtctggatctgctgaagatatggatgatgatggtgatgcagataagtatgagctggatccaacctgctgtttgatgtgtgacaaaaaacataagaccttagagagctgtatgcttcacatgcataagcatcatggtttctttattcccgatattgagtatctcaaggatcctgaagggcttctcacttaccttggtcttaaggtcaagagagacttcatgtgtctgtactgcaatgagctgtgccgtccattcagcagcttagaagctgtaagaaaacatatggaagcaaagagtcattgcaaactgcattatggtgatggtgatgatgaagaagatgctgagctagaagagttttatgactacagcagcagctatgttgatgaagctggaaagcaaattgttgtatctggtgaaacagacaatactgtagaactcgttggtggttctgagctcttgatcacggagaagtccgagaacacaacaacgtctaaaactctcgggtcccgtgaattcatgcgttactacagacagaagccacgcccaacttctcaagacagcaaccagataattgcctctttatcttcaaggtttgttttctccaaacccgttaatcatccgagtctatccaatcagataatcggcaaggtacaagagcctgggtctgaagacagtaccgtcgaaagaggagactttgaggatgaaagtgcgcaaggagatgagcaagagaggcgagacaatgcgtaccaagatcggagtgaagagtaa

SEQ ID NO: 512 - protein, 433 aa, Arabidopsis thaliana
  G376 Amino Acid Sequence
MGQMGYSCIGSGTESIDIEGEKMPGLTCNACNMEFKDEEERNLHYKSDWHRYNLKRKVAGVPGVTEALFEARQSALAQEKNKSNEAPMLYTCAICAKGYRSSKAHEQHLQSRSHVLRVSQGTSINGEEDIAIIRQLPRRVQHRGSIDDDSEDEWVEVDSDEELAAEEASDSLSKLNVNESGSAEDMDDDGDADKYELDPTCCLMCDKKHKTLESCMLHMHKHHGFFIPDIEYLKDPEGLLTYLGLKVKRDFMCLYCNELCRPFSSLEAVRKHMEAKSHCKLHYGDGDDEEDAELEEFYDYSSSYVDEAGKQIVVSGETDNTVELVGGSELLITEKSENTTTSKTLGSREFMRYYRQKPRPTSQDSNQIIASLSSRFVFSKPVNHPSLSNQIIGKVQEPGSEDSTVERGDFEDESAQGDEQERRDNAYQDRSEE

SEQ ID NO: 513 - DNA, 2020 bp, Arabidopsis thaliana
  G376 DNA sequence used for BLAST
ttactcttcactccgatcttggtacgcattgtctcgcctctcttgctcatctccttgcgcactttcatcctcaaagtctcctctttcgacggtactgtcttcagacccaggctcttgtacctgagaatttaccatttgttggaataaccttagtttaccttgccgattatctgattggatagactcggatgattaacgggtttggagaaaacaaaccttgaagataaagaggcaattatctggttgctgtcttgagaagttgggcgtggcttctgtctgtagtaacgcatgaattcacgggacccgagagttttagacgttgttgtgttctcggacttctccgtgatcaagagctcagaaccaccaacgagttctacagtattgtctgtttcaccagatacaacaatttgctttccagcttcatcaacatagctgctcaattcatatattccaaagaaaggtgcggattaagatttggcatagaacgaggaatacaggcgagaacaagaataatcagagatagaagagagttgaaacctgctgctgtagtcataaaactcttctagctcagcatcttcttcatcatcaccatcaccataatgcagtttgcaatgactctttgcttccatatgttttcttacagcttctaagctgctgaatggacggcacagctcattgcagtacagacacatgaagtctctcttgacctaaatgatgagcaatgtataagtaaacaggagtaagaatttcaaagcttgacaacaacgaacactgaatggtaaattgatgagtccaaaccttaagaccaaggtaagtgagaagcccttcaggatccttgagatactcaatatcgggaataaagaaaccatgatgcttatgcatgtgaagcatacagctctctaaggtcttatgttttttgtcacacatcaaacagcaggttggatccagctcatacttatctgcatcaccatcatcatccatatcttcagcagatccagactcattcacattcaacttagacaaagaatcagaggcttcttcagcagccaattcctcgtcagaatcaacctccacccattcatcttcactatcatcatcaatggaacccctgtgttgaacacggcgaggaagttgcctgataatcgctatatcctcctctccgttgattgatgtcccttgtgaaacccgcaaaacatggctacgcgactgaagatgctgctcatgagccttggaactcctgtaacctttagcacagattgcacaagtataaagcataggtgcttcatttgatttattcttctcctgagcaagagcagattgtctagcctcaaacaaggcttctgtaactccaggaactccagccacctaacataaaaaattacagaaatacaaagattcaaatgcctagaagtaaccaaatctatgattattgaaatccttgttccttagtagaataagcttcaaaacaaattttcatataaactctacgattccataaccttaactaaacaatttcgatagcaaaatggaaaagctgtttctcagaaactttcatctcatcaccgacgcaagattttcccgagaaacagataggcttgagttcaaattcgatagagaaagcagaagaaatgaaaccttgcgcttgagattgtagcggtgccaatcggatttgtaatgaaggttacgttcttcttcgtccttgaactccatgttacacgcgttacatgttaaaccaggcatcttctctccttcaatatcgatcgattctagaaatggaaactggagaagaaaagaaaatcagagaaaagatagttgggaggataagatttgttgttgatatgtgtagagcaacgacggctcgtaaatggatcggcgatcgtgtttgtctctaaaaaagcgtcgattgatgatgattgattgccatcaaaatgaaaaggaaggcgccccgcccattttagatccgatcgggttggaactgacccgttcctgacccgatacaagagtagcccatttggcccat

SEQ ID NO: 514 - DNA, 726 bp, Arabidopsis thaliana; identical to SEQ ID NO: 16
  G378 cDNA Sequence

SEQ ID NO: 515 - protein, 241 aa, Arabidopsis thaliana
  G378 Amino Acid Sequence
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 516 - DNA, 1171 bp, Arabidopsis thaliana
  G378 Genomic Sequence
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactaggtttgttttcgtttcttgtaactcttcttgagattgtctgtagttctaaaactcgattttggatctaattgttgctcatcttcgattggattgagttggatcattgaattgatttgattattagaaagtttgtaacttggagctaagaaagctgattcctttttcatgttcagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttggtgagcaacattacttgctctgttttttaagtagctatgaagtttggaatgtggtgattagtgtttcttttgtgaattttttgtgtagattgatgtcattgttagtcttctaagcgggagacttgtacgagagcgcattggtcctgcaatgctaagtgcagtgcaaagtcaagtatgtttgctttcagaatttttcaccatttccttaatgtttttaggatctctaggatctctgtagttatttatcccttcttgtcttgtttctcctgatcagatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggttagttctattgtcagtttgcttcgttttagttcattatgtcgaatcgagttctaattcgggttttgtctttctccttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 517 - DNA, 1171 bp, Arabidopsis thaliana
  G378 DNA sequence used for BLAST
ttaaatatcacgtctacacatcgggcaagaaccgtgtctaaggagccaattgtctatgcaaggtaagtgaaacatgtgatgacaatgaggcaagcttctaactgtttcaccgagctggaaatcctgaaggagaaagacaaaacccgaattagaactcgattcgacataatgaactaaaacgaagcaaactgacaatagaactaacctgaagacaaacagaacatgagtctgtgttctcagaagcatcagtgttattgttgccagtgattgtcatctttgggattttctcaacaaggtctcctgtcaatccttttgagcctcctgtatcaaaaaggcttgtgtgatcatcaaaagctgtatccacagctcccatctgatcaggagaaacaagacaagaagggataaataactacagagatcctagagatcctaaaaacattaaggaaatggtgaaaaattctgaaagcaaacatacttgactttgcactgcacttagcattgcaggaccaatgcgctctcgtacaagtctcccgcttagaagactaacaatgacatcaatctacacaaaaaattcacaaaagaaacactaatcaccacattccaaacttcatagctacttaaaaaacagagcaagtaatgttgctcaccaagtagagaaaacatccgaaacccgactcatcggatttccagagatccagagatgattcaaagacctcgatagagaaaacagctcccgaaatggctccaattgctgctcctctaatgaaaccactctcagtttcttgacctatcaaagctcctgtaagtgcccctagcaatgtgcccactgaacatgaaaaaggaatcagctttcttagctccaagttacaaactttctaataatcaaatcaattcaatgatccaactcaatccaatcgaagatgagcaacaattagatccaaaatcgagttttagaactacagacaatctcaagaagagttacaagaaacgaaaacaaacctagtgcgaagaagaaggtcaagatcgcggagataatggtacccaaaacagcagagacaaggaaatgacaagcgtctttaatgcgttcgacgaaattcccaagagaaggacttgacgaaagagggtaagacccagattggaatctataagatgatgatgatgacgaggccat

SEQ ID NO: 518 - DNA, 2940 bp, Arabidopsis thaliana
  G384 cDNA Sequence
gttttttcttctgaagagtgatatatattctacctttctctggttaaagaaactccctgaatccaccggttatgtcttgaccggctttaagcctataaactgatgccctaagacacctttttaggtttctcaataattctccgcatctatcttttcttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggaggtttagggagtttatgataatgtttgtgttcttttggtttttaaagtcttttgagattctccaaaggaagtcaagaacgctcctttttgcgtttaatctcatttccgcgtttgttagcggacgggccaaagaaagaggcttgagaaagaaaaggtaaagaggttcgggtattgacttctgctggaaccaaaaaaaaaggaatcgggtttgttgtgtttcggcggtttagcattttgcgttttctttgttattatttatcattgactagtgaacagtttagcgttctgcttttcgcgtctactgtgaaactccttgttattaagccactctagtggtactgtcattatatattatgaatctatgaaactgtgtttattagtttgtttctttaatccaaacttgagattctcttct

SEQ ID NO: 519 - protein, 718 aa, Arabidopsis thaliana
  G384 Amino Acid Sequence
MENPLEEELQDPNQRPNKKKRYHRHTQRQIQELESFFKECPHPDDKQRKELSRELSLEPLQVKFWFQNKRTQMKAQHERHENQILKSENDKLRAENNRYKDALSNATCPNCGGPAAIGEMSFDEQHLRIENARLREEIDRISAIAAKYVGKPLMANSSSFPQLSSSHHIPSRSLDLEVGNFGNNNNSHTGFVGEMFGSSDILRSVSIPSEADKPMIVELAVAAMEELVRMAQTGDPLWVSSDNSVEILNEEEYFRTFPRGIGPKPIGLRSEASRESTVVIMNHINLIEILMDVNQWSSVFCGIVSRALTLEVLSTGVRGNYNGALQVMTAEFQVPSPLVPTRENYFVRYCKQHSDGIWAVVDVSLDSLRPSPITRSRRRPSGCLIQELQNGYSKVTWVEHIEVDDRSVHNMYKPLVNTGLAFGAKRWVATLDRQCERLASSMASNIPACDLSVITSPEGRKSMLKLAERMVMSFCTGVGASTADAWTTLSTTGSDDVRVMTRKSMDDPGRPPGIVLSAATSFWIPVAPKRVFDFLRDENSRSEWDILSNGGLVQEMAHIANGRDPGNSVSLLRVNSGNSGQSNMLILQESCTDASGSYVIYAPVDIIAMNVVLSGGDPDYVALLPSGFAILPDGSARGGGGSANASAGAGVEGGGEGNNLEVVTTTGSCGGSLLTVAFQILVDSVPTAKLSLGSVATVNSLIKCTVERIKAALACDGA

SEQ ID NO: 520 - DNA, 3147 bp, Arabidopsis thaliana
  G384 DNA sequence used for BLAST
atggagaatcctttagaagaagagcttcaagatcctaatcagcgtcccaacaaaaagaagcgttaccaccgtcacacacaacgccagattcaagagctagagtcgtaagaattttttctacttgaaaatgtttttattgtttttcgaggatcacttagggtttatgtgtatttgtttgtttggttacggttttaggttcttcaaggaatgtcctcatccagacgataagcaaagaaaggagctgagtcgcgagctaagcttagaacctcttcaagtcaagttttggttccaaaacaaacgcactcaaatgaaggtatttttactatatagtatatatatacttcggccaattttgattattaattctattattttcatttaccggtctcgaatcttcaagagagttatatatatatttttcagaataatcaaatgaatttgatgtgtatttccaaccacattttgatttagatactacgaagccttatttaaacacatgtacttagctagttccaagattaagttcattttgtcaaaagatctatccatttgttttggtatatactcttgatgagaccaaacataagaagatatataacattgggacttgtataggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtggtataattctgttactctaactctgatttttaaaattttaacaaaggttctaacttatagttgacacttttgctgttctttctctgtatagaatcaatggtctagtgtgttctgcgggattgtatcaagagcattgactctagaagttctctcaactggcgtagcagggaactacaatggggcattgcaagtggtatgacactcaaagaccttgatttggttacttgctttacaaggtattattcttaatcatgtagtgagatttctcatgtgtttgatctttgttttcttggtatgcaaaagatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtaaacttaaggtctaaattgataattttaaaagtatgaggttgagaatttgaaaagaagagaaatgattaggtgatggttttgttttgtttgaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccggtatgtacaccacaccatcaaatgaaaatatttttagggtcattttgatcaatttgttaatattggtattaaattgaaaaatattaatttactaattgagtcccttaactttatggtaattatgaaagtgataacgagtcctgaggggagaaagagcatgctgaaactagcggagagaatggtgatgagcttctgtaccggagtcggcgcgtcaactgcgcatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgaggtaattaatactcaagtcataaagaggccctttttgaaaaaaagatcgataagttacttattcttgagttcaatttttgcagtgggatatactttccaatggaggcttggttcaagaaatggctcatatcgcaaatggtcgtgatcctgggaatagtgtctccttgcttcgagtcaatgtaagtaatgttcttgaaatctagtagtttctgtataaccccactgttgcttgtgttcaaagtctcaacattttgtttgtttaaaaacagagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaa

SEQ ID NO: 521 - DNA, 2217 bp, Arabidopsis thaliana
  G385 cDNA Sequence
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 522 - protein, 721 aa, Arabidopsis thaliana
  G385 Amino Acid Sequence
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 523 - DNA, 4207 bp, Arabidopsis thaliana
  G385 Genomic Sequence
gtttcctacaatcatctccaattcttctgtttgcttatatcattttgtatgatcttcaagaagaaagataaacgactccgaagaaagatttaagttattgttgttcatacaaaaagaaggttgtaaagttgttgacgtggacaaaagtattgccatatttttccagcctcgaagaaatttcccttcttcttcaaaccctaaattttgacaaaactctctacttttttttgcttctagggtttgctttcagtttccggagtataagaaaagatgttcgagccaaatatgctgcttgcggctatgaacaacgcagacagcaataaccacaactacaaccatgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgtatgtgtttaacttactcacttacttcaattttcttgtgtgttttttgacaattcttttgttttggttgttaaataggttcttcaaagagtgtcctcacccagatgacaagcaaaggaaacagctaagccgtgaattgaatttggaacctcttcaggtcaaattctggttccaaaacaaacgtacccaaatgaaggtatactttttatattatgaacatatatacattagttaatggatctatatatattagagaaaatatatatacttgttaattaaattgttatttcattcatattaagtcttgtatatatacattgaagggcttatctttatacttaagaacattttgggtggctggtgttttctttcagaatgaattcattgacttttggcagattttagatctagttgagacactttgacttaaaatttcttacttattttttttttcaattgaaaagttgttcctttggcagaactatatatttggcggatcaagctatagaaaattgtttggttgtaacaacattgcctatttattatcttagttagagccatatataatctatagattgaaacgttttggacacatatgcttacgttatgcaaatacggtgaaacacataacgtgtacacgagtgttttatttgaaacatacacttttcctctttttaagtaaaatcctttgttccttcgttttacccaaattagaaataaatcacttgtataaaactttagagataaccggaatataagttttatttgcgcagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagaggtatgagaatcaactattttaaatgttcaaataatgttaagagttttacacttaaatgttgtcaagaagataaaataaaaaattagaatttgtttttataccactaatgttatatcgctttcacaataatcatttctttcttcataaaataaaaacttttatagatttgtattgaaattagagaatttaaacatttttttttcattgaagaatagaaaaaattatgatattaaattgagatactaaaacgatatttttggaactgtaaggagtagtagtacataataacaacattactcaacgtttcttcttgtgaccaaactttgaaaaccacaaggatcaataatctttcttatttgtctgttttagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggttttagacgaagaagaatatgcaaggacctttcctagagggatcggacctagaccggctggatatagatcagaagcttcgcgagaaagcgcggttgtgatcatgaatcatgttaacatcgttgagattctcatggatgtggtaattaacattttcattttacttaaaagcaatcttctctgtttagtttcaacaacattgatatgatgttgcagaatcaatggtcgacgattttcgcggggatggtttctagagcaatgacattagcggttttatcgacaggagttgcaggaaactataatggagctcttcaagtggtaattttttttgcttttattctgtaaaaattaaatttcaaactgaaataaccactctgttttgcttgcagatgagtgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtaatataataaaaacattaggttatacaaaatgtttacttaagtagagagaattaatgtaacaggtgacttgggtggagcatgtggaagttgatgacagaggagttcataacttatacaaacacatggttagtactggtcatgcctttggtgctaaacgctgggtagccattcttgaccgccaatgcgagcggttagctagtgtcatggctacaaacatttcctctggagaagttggcggtataacctactgtttgtttcataaacagttttcataatcagagtcagagtcagaatcacagttctatattaatgaatatgcagtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggcctcctggtattgttcttagtgcagccacttctttttggatccctgttcctccaaagcgagtctttgacttcctcagagacgagaattcaagaaatgaggtaactattttagttactacgctctcttgttctgttttggacagagttttgatgtttttgtgagattttgcagtgggatattctgtctaatggaggagttgtgcaagaaatggcacatattgctaacgggagggataccggaaactgtgtttctcttcttcgggtaaatgtgagttacaccgggttttgaactattgttataatcatctgatcctagctaagagttttcaatctttctttatgtcacagagtgcaaactctagccagagcaatatgctgatcctacaagagagctgcactgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaacaatctaatagcttgcactgttgagagaatcaaagcttcaatgtcttgtgagactgcttgaaaaccatccattaggtactactttcactaaatatattcttctcgcttttacgccattatatgatgtaatcatatttttcttcttctttctgcaggaaataacaaaatggtgatgatggaaaaaagagagagatttcagtttgagaaaagcggaggagtcaagatcgaacctcacaagagaataccattgagtgtttgttagtgttaagttttggtctgcttatttgatgaaactaagcagtgaaaaactttttacttgaaagtgaatatgtagatggttttacgaggttcgggaatttga

SEQ ID NO: 524 - DNA, 3637 bp, Arabidopsis thaliana
  G385 DNA sequence used for BLAST
atgttcgagccaaatatgctgcttgcggctatgaacaacgcagacagcaataaccacaactacaaccatgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgtatgtgtttaacttactcacttacttcaattttcttgtgtgttttttgacaattcttttgttttggttgttaaataggttcttcaaagagtgtcctcacccagatgacaagcaaaggaaacagctaagccgtgaattgaatttggaacctcttcaggtcaaattctggttccaaaacaaacgtacccaaatgaaggtatactttttatattatgaacatatatacattagttaatggatctatatatattagagaaaatatatatacttgttaattaaattgttatttcattcatattaagtcttgtatatatacattgaagggcttatctttatacttaagaacattttgggtggctggtgttttctttcagaatgaattcattgacttttggcagattttagatctagttgagacactttgacttaaaatttcttacttattttttttttcaattgaaaagttgttcctttggcagaactatatatttggcggatcaagctatagaaaattgtttggttgtaacaacattgcctatttattatcttagttagagccatatataatctatagattgaaacgttttggacacatatgcttacgttatgcaaatacggtgaaacacataacgtgtacacgagtgttttatttgaaacatacacttttcctctttttaagtaaaatcctttgttccttcgttttacccaaattagaaataaatcacttgtataaaactttagagataaccggaatataagttttatttgcgcagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagaggtatgagaatcaactattttaaatgttcaaataatgttaagagttttacacttaaatgttgtcaagaagataaaataaaaaattagaatttgtttttataccactaatgttatatcgctttcacaataatcatttctttcttcataaaataaaaacttttatagatttgtattgaaattagagaatttaaacatttttttttcattgaagaatagaaaaaattatgatattaaattgagatactaaaacgatatttttggaactgtaaggagtagtagtacataataacaacattactcaacgtttcttcttgtgaccaaactttgaaaaccacaaggatcaataatctttcttatttgtctgttttagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggttttagacgaagaagaatatgcaaggacctttcctagagggatcggacctagaccggctggatatagatcagaagcttcgcgagaaagcgcggttgtgatcatgaatcatgttaacatcgttgagattctcatggatgtggtaattaacattttcattttacttaaaagcaatcttctctgtttagtttcaacaacattgatatgatgttgcagaatcaatggtcgacgattttcgcggggatggtttctagagcaatgacattagcggttttatcgacaggagttgcaggaaactataatggagctcttcaagtggtaattttttttgcttttattctgtaaaaattaaatttcaaactgaaataaccactctgttttgcttgcagatgagtgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtaatataataaaaacattaggttatacaaaatgtttacttaagtagagagaattaatgtaacaggtgacttgggtggagcatgtggaagttgatgacagaggagttcataacttatacaaacacatggttagtactggtcatgcctttggtgctaaacgctgggtagccattcttgaccgccaatgcgagcggttagctagtgtcatggctacaaacatttcctctggagaagttggcggtataacctactgtttgtttcataaacagttttcataatcagagtcagagtcagaatcacagttctatattaatgaatatgcagtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggcctcctggtattgttcttagtgcagccacttctttttggatccctgttcctccaaagcgagtctttgacttcctcagagacgagaattcaagaaatgaggtaactattttagttactacgctctcttgttctgttttggacagagttttgatgtttttgtgagattttgcagtgggatattctgtctaatggaggagttgtgcaagaaatggcacatattgctaacgggagggataccggaaactgtgtttctcttcttcgggtaaatgtgagttacaccgggttttgaactattgttataatcatctgatcctagctaagagttttcaatctttctttatgtcacagagtgcaaactctagccagagcaatatgctgatcctacaagagagctgcactgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaacaatctaatagcttgcactgttgagagaatcaaagcttcaatgtcttgtgagactgcttga

SEQ ID NO: 525 - DNA, 2238 bp, Arabidopsis thaliana
  G388 cDNA Sequence
atggccgtcgacatgtcttccaaacaacccaccaaagactttttctcctctccagccctctctctatctctcgctgggatattccggaatgcatcctccggcagcaccaaccctgaggaggatttcctgggcagaagagtagttgacgatgaggatcgcactgtggagatgagcagcgagaactcaggacccacgagatccagatcagaggaggatttggagggtgaggatcacgacgatgaggaggaggaagaggaggacggcgcagctggaaacaagggcactaataagagaaagaggaagaagtatcatcgtcacaccaccgatcagatcagacacatggaagcgctattcaaagagacaccacatccggacgagaagcaaagacagcagctgagcaagcaactagggctggcccctcgccaggtcaagttctggttccaaaaccgccgcacacagatcaaggctattcaagaacggcacgagaactccctgctcaaggcggaactagagaagctgcgagaggaaaacaaagccatgagggagtctttttccaaggctaattcctcctgccccaactgcggaggaggccccgatgatctccacctcgaaaactccaaactgaaagccgagctcgataagcttcgtgcagctcttggacgcactccctatcccctgcaggcttcatgctccgacgatcaagaacaccgtctcggctctctcgatttctacacgggcgtctttgccctcgagaagtcccgtattgccgagatttctaaccgagccacccttgaactccagaagatggccacctcaggcgaacctatgtggctccgcagcgttgagactggccgtgagattctcaactacgatgagtacctcaaggagtttccccaagcgcaagcctcttcgtttcctggaaggaaaaccatcgaagcatctagagatgcggggattgtgtttatggacgcacataaacttgcccagagtttcatggacgtgggacaatggaaagagacatttgcatgcttgatctcaaaggctgcaacggtcgatgttatccggcaaggcgaagggccttcacggatcgacggggctattcagctgatgttcggagagatgcagctgctcactccggtcgtccccacaagagaagtgtacttcgtgagaagctgccggcagctgagccctgagaaatgggcaatagtggacgtctcggtctccgtggaggacagcaacacggagaaggaggcttctcttctgaaatgtcgaaaactcccctccggttgcatcatcgaggacacctccaacggtcactccaaggtcacctgggtggagcacctcgacgtgtctgcatccacagttcagcctctcttccgctccttagtcaacaccggtttggcctttggggctcgacactgggtcgccacccttcagctccattgcgaacgccttgtcttcttcatggctaccaacgtccccaccaaagactctctcggagttacaactcttgccgggagaaagagtgtgctgaagatggctcagagaatgacacaaagcttctaccgcgccattgctgcatcaagctaccatcaatggaccaaaatcaccaccaaaactggacaagacatgcgggtttcttccaggaagaaccttcatgatcctggcgagcccacgggagtcattgtctgcgcttcttcttcgctgtggttacctgtttctccagctcttctcttcgatttctttagagatgaagctcgtcggcatgagtgggatgctttgtcaaacggagctcatgttcagtctattgcaaacttatccaagggacaagacagaggcaactcagtggcaatccagacagtgaaatcgagagaaaagagcatatgggtgctgcaagacagcagcactaactcgtatgagtcggtggtggtatacgctcccgtagatataaacacgacacagctggtgctcgcgggacatgatccaagcaacatccaaatcctcccctctggattctcaatcatacctgatggagtagagtcacggccactggtaataacgtctacacaagacgacagaaacagccaaggagggtcgctcctgacactcgccctccaaaccctcatcaacccttctcctgcagcaaagctgaatatggagtctgtggaatccgtgacaaacctcgtctcagtcacactacacaacattaagagaagtctacaaatcgaagattgctga

SEQ ID NO: 526 - protein, 745 aa, Arabidopsis thaliana
  G388 Amino Acid Sequence
MAVDMSSKQPTKDFFSSPALSLSLAGIFRNASSGSTNPEEDFLGRRVVDDEDRTVEMSSENSGPTRSRSEEDLEGEDHDDEEEEEEDGAAGNKGTNKRKRKKYHRHTTDQIRHMEALFKETPHPDEKQRQQLSKQLGLAPRQVKFWFQNRRTQIKAIQERHENSLLKAELEKLREENKAMRESFSKANSSCPNCGGGPDDLHLENSKLKAELDKLRAALGRTPYPLQASCSDDQEHRLGSLDFYTGVFALEKSRIAEISNRATLELQKMATSGEPMWLRSVETGREILNYDEYLKEFPQAQASSFPGRKTIEASRDAGIVFMDAHKLAQSFMDVGQWKETFACLISKAATVDVIRQGEGPSRIDGAIQLMFGEMQLLTPVVPTREVYFVRSCRQLSPEKWAIVDVSVSVEDSNTEKEASLLKCRKLPSGCIIEDTSNGHSKVTWVEHLDVSASTVQPLFRSLVNTGLAFGARHWVATLQLHCERLVFFMATNVPTKDSLGVTTLAGRKSVLKMAQRMTQSFYRAIAASSYHQWTKITTKTGQDMRVSSRKNLHDPGEPTGVIVCASSSLWLPVSPALLFDFFRDEARRHEWDALSNGAHVQSIANLSKGQDRGNSVAIQTVKSREKSIWVLQDSSTNSYESVVVYAPVDINTTQLVLAGHDPSNIQILPSGFSIIPDGVESRPLVITSTQDDRNSQGGSLLTLALQTLINPSPAAKLNMESVESVTNLVSVTLHNIKRSLQIEDC

SEQ ID NO: 527 - DNA, 3482 bp, Arabidopsis thaliana
  G388 Genomic Sequence
atggccgtcgacatgtcttccaaacaacccaccaaagactttttctcctctccagccctctctctatctctcgtatactactctctcttttctacatacatgtacttgctagctctcacataaacatatattatatatatgtcttgattttaatggagataggaatatatacaggctgggatattccggaatgcatcctccggcagcaccaaccctgaggaggatttcctgggcagaagagtagttgacgatgaggatcgcactgtggagatgagcagcgagaactcaggacccacgagatccagatcagaggaggatttggagggtgaggatcacgacgatgaggaggaggaagaggaggacggcgcagctggaaacaagggcactaataagagaaagaggaagaagtatcatcgtcacaccaccgatcagatcagacacatggaagcgtacgttcgatataattattccatccttacctagctaactaattaaaccccccaccccactttttaataagtataaacttaataattatgcttcacaaattaaaacacttaattaggggattccgattcattagggctagcttctatcaagaaacattcattagttgttttttccggtgctcatatttcttgatgttttataagtaattatgattttaatccctttcttcggtatatactgtagtacttaattagtggaagaaggagaaggtgtcttgcgttgaagagcaattctcaattacgcaccttcaattctccattaatttcacatacatatatatacttagatgatgtattcatacaaatatattgccgatcgatgatatatgatccagcattagtttcaatgcgcttatatggtttcggacgcttactcgttattattccccgtcttctcctgacatgactgtaggtacatgcgcgttataacgtatataaaggcttaaacaataaagtgttaatttgtttcatcacaattaaagctgatcagtaatagtatacatatgcctagttagggttcagttgcatgtaaagattttcatcttttagaaatgtctgaatttgaggacgttgcaggctattcaaagagacaccacatccggacgagaagcaaagacagcagctgagcaagcaactagggctggcccctcgccaggtcaagttctggttccaaaaccgccgcacacagatcaaggtaatgtatatcttacgtgatatggatttttgtctgactatagtagtatatatatagtttatgaatcaatcatgcatggacaggctattcaagaacggcacgagaactccctgctcaaggcggaactagagaagctgcgagaggaaaacaaagccatgagggagtctttttccaaggctaattcctcctgccccaactgcggaggaggccccgatgatctccacctcgaaaactccaaactgaaagccgagctcgataagcttcgtgcagctcttggacgcactccctatcccctgcaggcttcatgctccgacgatcaagaacaccgtctcggctctctcgatttctacacgggcgtctttgccctcgagaagtcccgtattgccgagatttctaaccgagccacccttgaactccagaagatggccacctcaggcgaacctatgtggctccgcagcgttgagactggccgtgagattctcaactacgatgagtacctcaaggagtttccccaagcgcaagcctcttcgtttcctggaaggaaaaccatcgaagcatctagagatgcggggattgtgtttatggacgcacataaacttgcccagagtttcatggacgtggtacttttccattatttattactgttaccagctactataacttattctatgtgtataaaaaggaattgatgtgtacgtgtaacgcgcagggacaatggaaagagacatttgcatgcttgatctcaaaggctgcaacggtcgatgttatccggcaaggcgaagggccttcacggatcgacggggctattcagctggtgagtactcatcaatatatacatatagtgataattgatgaatgacgactcagctgatacatgggatggatatggtttataactattgtggcagatgttcggagagatgcagctgctcactccggtcgtccccacaagagaagtgtacttcgtgagaagctgccggcagctgagccctgagaaatgggcaatagtggacgtctcggtctccgtggaggacagcaacacggagaaggaggcttctcttctgaaatgtcgaaaactcccctccggttgcatcatcgaggacacctccaacggtcactccaaggtcacctgggtggagcacctcgacgtgtctgcatccacagttcagcctctcttccgctccttagtcaacaccggtttggcctttggggctcgacactgggtcgccacccttcagctccattgcgaacgccttgtcttcttcatggctaccaacgtccccaccaaagactctctcggtccgtctatatatccggatcctccatttacactctctatctttctttatatataaccttttcactcctctgttgataatcaggagttacaactcttgccgggagaaagagtgtgctgaagatggctcagagaatgacacaaagcttctaccgcgccattgctgcatcaagctaccatcaatggaccaaaatcaccaccaaaactggacaagacatgcgggtttcttccaggaagaaccttcatgatcctggcgagcccacgggagtcattgtctgcgcttcttcttcgctgtggttacctgtttctccagctcttctcttcgatttctttagagatgaagctcgtcggcatgaggtaccttgtcaaattcacacacatttaagcaaacaagaaaagcggtttccactcatatatttatctaacgatacatatcatcagtgggatgctttgtcaaacggagctcatgttcagtctattgcaaacttatccaagggacaagacagaggcaactcagtggcaatccaggtgcgtttattttgtcttctcctcctctaaatctgtctaggccttgataatctgaatttctatacatttccagacagtgaaatcgagagaaaagagcatatgggtgctgcaagacagcagcactaactcgtatgagtcggtggtggtatacgctcccgtagatataaacacgacacagctggtgctcgcgggacatgatccaagcaacatccaaatcctcccctctggattctcaatcatacctgatggagtagagtcacggccactggtaataacgtctacacaagacgacagaaacagccaaggagggtcgctcctgacactcgccctccaaaccctcatcaacccttctcctgcagcaaagctgaatatggagtctgtggaatccgtgacaaacctcgtctcagtcacactacacaacattaagagaagtctacaaatcgaagattgctga

SEQ ID NO: 528 - DNA, 3482 bp, Arabidopsis thaliana
  G388 DNA sequence used for BLAST
tcagcaatcttcgatttgtagacttctcttaatgttgtgtagtgtgactgagacgaggtttgtcacggattccacagactccatattcagctttgctgcaggagaagggttgatgagggtttggagggcgagtgtcaggagcgaccctccttggctgtttctgtcgtcttgtgtagacgttattaccagtggccgtgactctactccatcaggtatgattgagaatccagaggggaggatttggatgttgcttggatcatgtcccgcgagcaccagctgtgtcgtgtttatatctacgggagcgtataccaccaccgactcatacgagttagtgctgctgtcttgcagcacccatatgctcttttctctcgatttcactgtctggaaatgtatagaaattcagattatcaaggcctagacagatttagaggaggagaagacaaaataaacgcacctggattgccactgagttgcctctgtcttgtcccttggataagtttgcaatagactgaacatgagctccgtttgacaaagcatcccactgatgatatgtatcgttagataaatatatgagtggaaaccgcttttcttgtttgcttaaatgtgtgtgaatttgacaaggtacctcatgccgacgagcttcatctctaaagaaatcgaagagaagagctggagaaacaggtaaccacagcgaagaagaagcgcagacaatgactcccgtgggctcgccaggatcatgaaggttcttcctggaagaaacccgcatgtcttgtccagttttggtggtgattttggtccattgatggtagcttgatgcagcaatggcgcggtagaagctttgtgtcattctctgagccatcttcagcacactctttctcccggcaagagttgtaactcctgattatcaacagaggagtgaaaaggttatatataaagaaagatagagagtgtaaatggaggatccggatatatagacggaccgagagagtctttggtggggacgttggtagccatgaagaagacaaggcgttcgcaatggagctgaagggtggcgacccagtgtcgagccccaaaggccaaaccggtgttgactaaggagcggaagagaggctgaactgtggatgcagacacgtcgaggtgctccacccaggtgaccttggagtgaccgttggaggtgtcctcgatgatgcaaccggaggggagttttcgacatttcagaagagaagcctccttctccgtgttgctgtcctccacggagaccgagacgtccactattgcccatttctcagggctcagctgccggcagcttctcacgaagtacacttctcttgtggggacgaccggagtgagcagctgcatctctccgaacatctgccacaatagttataaaccatatccatcccatgtatcagctgagtcgtcattcatcaattatcactatatgtatatattgatgagtactcaccagctgaatagccccgtcgatccgtgaaggcccttcgccttgccggataacatcgaccgttgcagcctttgagatcaagcatgcaaatgtctctttccattgtccctgcgcgttacacgtacacatcaattcctttttatacacatagaataagttatagtagctggtaacagtaataaataatggaaaagtaccacgtccatgaaactctgggcaagtttatgtgcgtccataaacacaatccccgcatctctagatgcttcgatggttttccttccaggaaacgaagaggcttgcgcttggggaaactccttgaggtactcatcgtagttgagaatctcacggccagtctcaacgctgcggagccacataggttcgcctgaggtggccatcttctggagttcaagggtggctcggttagaaatctcggcaatacgggacttctcgagggcaaagacgcccgtgtagaaatcgagagagccgagacggtgttcttgatcgtcggagcatgaagcctgcaggggatagggagtgcgtccaagagctgcacgaagcttatcgagctcggctttcagtttggagttttcgaggtggagatcatcggggcctcctccgcagttggggcaggaggaattagccttggaaaaagactccctcatggctttgttttcctctcgcagcttctctagttccgccttgagcagggagttctcgtgccgttcttgaatagcctgtccatgcatgattgattcataaactatatatatactactatagtcagacaaaaatccatatcacgtaagatatacattaccttgatctgtgtgcggcggttttggaaccagaacttgacctggcgaggggccagccctagttgcttgctcagctgctgtctttgcttctcgtccggatgtggtgtctctttgaatagcctgcaacgtcctcaaattcagacatttctaaaagatgaaaatctttacatgcaactgaaccctaactaggcatatgtatactattactgatcagctttaattgtgatgaaacaaattaacactttattgtttaagcctttatatacgttataacgcgcatgtacctacagtcatgtcaggagaagacggggaataataacgagtaagcgtccgaaaccatataagcgcattgaaactaatgctggatcatatatcatcgatcggcaatatatttgtatgaatacatcatctaagtatatatatgtatgtgaaattaatggagaattgaaggtgcgtaattgagaattgctcttcaacgcaagacaccttctccttcttccactaattaagtactacagtatataccgaagaaagggattaaaatcataattacttataaaacatcaagaaatatgagcaccggaaaaaacaactaatgaatgtttcttgatagaagctagccctaatgaatcggaatcccctaattaagtgttttaatttgtgaagcataattattaagtttatacttattaaaaagtggggtggggggtttaattagttagctaggtaaggatggaataattatatcgaacgtacgcttccatgtgtctgatctgatcggtggtgtgacgatgatacttcttcctctttctcttattagtgcccttgtttccagctgcgccgtcctcctcttcctcctcctcatcgtcgtgatcctcaccctccaaatcctcctctgatctggatctcgtgggtcctgagttctcgctgctcatctccacagtgcgatcctcatcgtcaactactcttctgcccaggaaatcctcctcagggttggtgctgccggaggatgcattccggaatatcccagcctgtatatattcctatctccattaaaatcaagacatatatataatatatgtttatgtgagagctagcaagtacatgtatgtagaaaagagagagtagtatacgagagatagagagagggctggagaggagaaaaagtctttggtgggttgtttggaagacatgtcgacggccat

SEQ ID NO: 529 - DNA, 1986 bp, Arabidopsis thaliana
  G389 cDNA Sequence
atggaaacgaaagacaagaaagaaaaaggacatatggttttaaattccgacaacgttttcggttcggtgtcttcgtctccgacaacaacaatccaaaaccctaattactttacctccttcgagaaccctaatttcccttacatttttccgaaagaagagtatgaggtgatgagcaagatcgaaagcgggtcgggtaagtcaaccgggtcgggtcatgacccagtggagaatactgcaatcgaacaagagcctcctgcggcgaagaagaaacgttaccatagacatactgctagtcagattcaacaaatggaagcattgtttaaggaaaatgctcatccggataccaaaacaagattgagattaagtaaaaaacttggtctctcgccgatacaagtcaagttttggtttcaaaacaaacgtacccaaatcaaggcacaacaaagtagaagcgataatgcaaagctaaaagcagagaatgagactctaaagacagagagtcaaaatattcagtccaattttcaatgccttttttgctctacttgtggccacaatctccgcctcgaaaacgctcgcctccgccaagagcttgatcgtttacgcagcattgtttccatgaggaatccttctccttcacaagagattaccccggagactaataagaacaacaacgataatatgttgattgcggaagaagaaaaggcgattgatatggaacttgcagtttcttgtgctcgagaattagcaaagatgtgtgacataaatgagcccttgtggaataagaagagactagacaatgagagtgtgtgtctgaatgaggaagagtataagaagatgttcttatggcctctaatgaatgatgatgatcgttttcgcagagaagcttcaagagctaatgcagtcatcatgttgaactgcataaccctcgtcaaagcattccttgatgctgataaatggtcggaaatgttcttccccatagtctcaagcgccaaaacggctcagatcatttcttctggagcttctggaccaagtggtactcttcttctgcaaaatgctgaagaaggaaaatggatggttgtagatttcccgatcgataggatcaaaccagcatcagctactactactgatcaataccggagaaaaccttctggttgcatcattcaagcaatgcgtaacggatactctcaggtcacatgggtagagcacgtagaagtagaagagaagcacgtgcaggacgaggttgttagagagtttgtggagagcggtgtggcctttggcgctgaacggtggctatctgtgttgaagagacaatgtgaaaggatggctagtctcatggctacaaacatcactgaccttggaggtatatatataacttgtttcacaatgataccttctgtagaagcgaggaagaacttgatgaagctgtcacagagaatggtgaaaactttctgtctgaacataatcaattcacacggacaagcaccaacaaaggacacagttaaaatcgtaagcaggaaagtttgcggtggtcttgttccttgtgccgtgtcagtcacgcttctcccttattctcatcaacaagtctttgatcttctccgcgacaatcaacgtctctctcaggtggagagcaattcatcgcataatgtagagttgatgcttcaagaaacatgcaccgataactccgggagtctcctggtgtactctaccgtcgaccccgtcgctgttcagctcgccatgaacggcgaagatccttctgaaataccacttttgcccgttggattctctgttgttccagtgaatccatccgatggtgtcgagggcagttccgtcagttcgccttcgtgcttgctcactgttgcaatacaggtcttggggagcaacgtcaccaccgaaagactcgatctttccaccgtctccgtcatcaatcaccgtatttgcgccactgtcaaccgtatcacttccgcgctcgtcaacgacgtcggtaattaa

SEQ ID NO: 530 - protein, 661 aa, Arabidopsis thaliana
  G389 Amino Acid Sequence
METKDKKEKGHMVLNSDNVFGSVSSSPTTTIQNPNYFTSFENPNFPYIFPKEEYEVMSKIESGSGKSTGSGHDPVENTAIEQEPPAAKKKRYHRHTASQIQQMEALFKENAHPDTKTRLRLSKKLGLSPIQVKFWFQNKRTQIKAQQSRSDNAKLKAENETLKTESQNIQSNFQCLFCSTCGHNLRLENARLRQELDRLRSIVSMRNPSPSQEITPETNKNNNDNMLIAEEEKAIDMELAVSCARELAKMCDINEPLWNKKRLDNESVCLNEEEYKKMFLWPLMNDDDRFRREASRANAVIMLNCITLVKAFLDADKWSEMFFPIVSSAKTAQIISSGASGPSGTLLLQNAEEGKWMVVDFPIDRIKPASATTTDQYRRKPSGCIIQAMRNGYSQVTWVEHVEVEEKHVQDEVVREFVESGVAFGAERWLSVLKRQCERMASLMATNITDLGGIYITCFTMIPSVEARKNLMKLSQRMVKTFCLNIINSHGQAPTKDTVKIVSRKVCGGLVPCAVSVTLLPYSHQQVFDLLRDNQRLSQVESNSSHNVELMLQETCTDNSGSLLVYSTVDPVAVQLAMNGEDPSEIPLLPVGFSVVPVNPSDGVEGSSVSSPSCLLTVAIQVLGSNVTTERLDLSTVSVINHRICATVNRITSALVNDVGN

SEQ ID NO: 531 - DNA, 2958 bp, Arabidopsis thaliana
  G389 Genomic Sequence
atggaaacgaaagacaagaaagaaaaaggacatatggttttaaattccgacaacgttttcggttcggtgtcttcgtctccgacaacaacaatccaaaaccctaattactttacctccttcgagaaccctaatttcccttacatttttccggtttgtcttcgtctccaaaaaccctaacttttttacatatttttcttaaaaaattaataactttattgtttttgtgggtttagaaagaagagtatgaggtgatgagcaagatcgaaagcgggtcgggtaagtcaaccgggtcgggtcatgacccagtggagaatactgcaatcgaacaagagcctcctgcggcgaagaagaaacgttaccatagacatactgctagtcagattcaacaaatggaagcgtacgtcttcttgcccttttagtttacaagtttattatgtcaaaaaaattataacgatgatttatgaaatgatgtttaaaatatgaaattttgcccttttattgtagattgtttaaggaaaatgctcatccggataccaaaacaagattgagattaagtaaaaaacttggtctctcgccgatacaagtcaagttttggtttcaaaacaaacgtacccaaatcaaggtaactaatcactctttagtttggtttgattttaacaaggttagttagaccatataaaccggtttaaaattggggttagaaactctggctaagaccattcatgttaagaaattaagcttttgttgttgctaatactgagattaacaggcacaacaaagtagaagcgataatgcaaagctaaaagcagagaatgagactctaaagacagagagtcaaaatattcagtccaattttcaatgccttttttgctctacttgtggccacaatctccgcctcgaaaacgctcgcctccgccaagaggtatgtatattcgaatgaatcaaatcttggctgttgttgtttatctactgaatcatatggttatcatatgttgcagcttgatcgtttacgcagcattgtttccatgaggaatccttctccttcacaagagattaccccggagactaataagaacaacaacgataatatgttgattgcggaagaagaaaaggcgattgatatggaacttgcagtttcttgtgctcgagaattagcaaagatgtgtgacataaatgagcccttgtggaataagaagagactagacaatgagagtgtgtgtctgaatgaggaagagtataagaagatgttcttatggcctctaatgaatgatgatgatcgttttcgcagagaagcttcaagagctaatgcagtcatcatgttgaactgcataaccctcgtcaaagcattccttgatgctgtaagaataagtcaaaaacacattccttatattcattgtttaaaaactcacattgaaccataaatatgtttaacctttgcttcaaggataaatggtcggaaatgttcttccccatagtctcaagcgccaaaacggctcagatcatttcttctggagcttctggaccaagtggtactcttcttctggtaagtaatttgcaattttacaatagatagagtgttcacattaattggttttaaggtcactgaatcttgtctctcttttcaaaaaagatgtttgcagagttacaagtagtgtctccattggtaccaacaagagaagcttattttcttcggtatgtggagcaaaatgctgaagaaggaaaatggatggttgtagatttcccgatcgataggatcaaaccagcatcagctactactactgatcaataccggagaaaaccttctggttgcatcattcaagcaatgcgtaacggatactctcaggtcacatgggtagagcacgtagaagtagaagagaagcacgtgcaggacgaggttgttagagagtttgtggagagcggtgtggcctttggcgctgaacggtggctatctgtgttgaagagacaatgtgaaaggatggctagtctcatggctacaaacatcactgaccttggaggtatatatataacttgtttcacaagtaaacctcaaacttccacaaccaatgtgattagttatccgttttctcgtgttttttccttcagtgataccttctgtagaagcgaggaagaacttgatgaagctgtcacagagaatggtgaaaactttctgtctgaacataatcaattcacacggacaagcaccaacaaaggacacagttaaaatcgtaagcaggaaagtttgcggtggtcttgttccttgtgccgtgtcagtcacgcttctcccttattctcatcaacaagtctttgatcttctccgcgacaatcaacgtctctctcaggtaaagaaagtaaaaccagaatcttcttcctctgttcttttgatccaaagattctgaaaatcgattctctgcagctggagatcttgttcatgggtagttcatttcaagaagttgctcatatcgctaatggctcacatcttggaaatagcatctctcttcttcggatcaatgttagtgattgattcaaaatcccaacaaaaaaaaaaatcgaattttgattttaaaacttaaaaagtttggtttttgaattacaggtggagagcaattcatcgcataatgtagagttgatgcttcaagaaacatgcaccgataactccgggagtctcctggtgtactctaccgtcgaccccgtcgctgttcagctcgccatgaacggcgaagatccttctgaaataccacttttgcccgttggattctctgttgttccagtgaatccatccgatggtgtcgagggcagttccgtcagttcgccttcgtgcttgctcactgttgcaatacaggtcttggggagcaacgtcaccaccgaaagactcgatctttccaccgtctccgtcatcaatcaccgtatttgcgccactgtcaaccgtatcacttccgcgctcgtcaacgacgtcggtaa

SEQ ID NO: 532 - DNA, 2962 bp, Arabidopsis thaliana
  G389 DNA sequence used for BLAST
ttaattaccgacgtcgttgacgagcgcggaagtgatacggttgacagtggcgcaaatacggtgattgatgacggagacggtggaaagatcgagtctttcggtggtgacgttgctccccaagacctgtattgcaacagtgagcaagcacgaaggcgaactgacggaactgccctcgacaccatcggatggattcactggaacaacagagaatccaacgggcaaaagtggtatttcagaaggatcttcgccgttcatggcgagctgaacagcgacggggtcgacggtagagtacaccaggagactcccggagttatcggtgcatgtttcttgaagcatcaactctacattatgcgatgaattgctctccacctgtaattcaaaaaccaaactttttaagttttaaaatcaaaattcgatttttttttttgttgggattttgaatcaatcactaacattgatccgaagaagagagatgctatttccaagatgtgagccattagcgatatgagcaacttcttgaaatgaactacccatgaacaagatctccagctgcagagaatcgattttcagaatctttggatcaaaagaacagaggaagaagattctggttttactttctttacctgagagagacgttgattgtcgcggagaagatcaaagacttgttgatgagaataagggagaagcgtgactgacacggcacaaggaacaagaccaccgcaaactttcctgcttacgattttaactgtgtcctttgttggtgcttgtccgtgtgaattgattatgttcagacagaaagttttcaccattctctgtgacagcttcatcaagttcttcctcgcttctacagaaggtatcactgaaggaaaaaacacgagaaaacggataactaatcacattggttgtggaagtttgaggtttacttgtgaaacaagttatatatatacctccaaggtcagtgatgtttgtagccatgagactagccatcctttcacattgtctcttcaacacagatagccaccgttcagcgccaaaggccacaccgctctccacaaactctctaacaacctcgtcctgcacgtgcttctcttctacttctacgtgctctacccatgtgacctgagagtatccgttacgcattgcttgaatgatgcaaccagaaggttttctccggtattgatcagtagtagtagctgatgctggtttgatcctatcgatcgggaaatctacaaccatccattttccttcttcagcattttgctccacataccgaagaaaataagcttctcttgttggtaccaatggagacactacttgtaactctgcaaacatcttttttgaaaagagagacaagattcagtgaccttaaaaccaattaatgtgaacactctatctattgtaaaattgcaaattacttaccagaagaagagtaccacttggtccagaagctccagaagaaatgatctgagccgttttggcgcttgagactatggggaagaacatttccgaccatttatccttgaagcaaaggttaaacatatttatggttcaatgtgagtttttaaacaatgaatataaggaatgtgtttttgacttattcttacagcatcaaggaatgctttgacgagggttatgcagttcaacatgatgactgcattagctcttgaagcttctctgcgaaaacgatcatcatcattcattagaggccataagaacatcttcttatactcttcctcattcagacacacactctcattgtctagtctcttcttattccacaagggctcatttatgtcacacatctttgctaattctcgagcacaagaaactgcaagttccatatcaatcgccttttcttcttccgcaatcaacatattatcgttgttgttcttattagtctccggggtaatctcttgtgaaggagaaggattcctcatggaaacaatgctgcgtaaacgatcaagctgcaacatatgataaccatatgattcagtagataaacaacaacagccaagatttgattcattcgaatatacatacctcttggcggaggcgagcgttttcgaggcggagattgtggccacaagtagagcaaaaaaggcattgaaaattggactgaatattttgactctctgtctttagagtctcattctctgcttttagctttgcattatcgcttctactttgttgtgcctgttaatctcagtattagcaacaacaaaagcttaatttcttaacatgaatggtcttagccagagtttctaaccccaattttaaaccggtttatatggtctaactaaccttgttaaaatcaaaccaaactaaagagtgattagttaccttgatttgggtacgtttgttttgaaaccaaaacttgacttgtatcggcgagagaccaagttttttacttaatctcaatcttgttttggtatccggatgagcattttccttaaacaatctacaataaaagggcaaaatttcatattttaaacatcatttcataaatcatcgttataatttttttgacataataaacttgtaaactaaaagggcaagaagacgtacgcttccatttgttgaatctgactagcagtatgtctatggtaacgtttcttcttcgccgcaggaggctcttgttcgattgcagtattctccactgggtcatgacccgacccggttgacttacccgacccgctttcgatcttgctcatcacctcatactcttctttctaaacccacaaaaacaataaagttattaattttttaagaaaaatatgtaaaaaagttagggtttttggagacgaagacaaaccggaaaaatgtaagggaaattagggttctcgaaggaggtaaagtaattagggttttggattgttgttgtcggagacgaagacaccgaaccgaaaacgttgtcggaatttaaaaccatatgtcctttttctttcttgtctttcgtttccat

SEQ ID NO: 533 - DNA, 2526 bp, Arabidopsis thaliana
  G390 cDNA Sequence
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 534 - protein, 841 aa, Arabidopsis thaliana
  G390 Amino Acid Sequence
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 535 - DNA, 4416 bp, Arabidopsis thaliana
  G390 Genomic Sequence
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcaggttattatttctttattaattgtctttaatggaatgttttttgtgttctttgattgtttctgtaattataaaattgaatttcttttgtttgtatttggagacaaaaatgttcttgtctgacaatgtttttggtaatcttcttgtttttggtctaattggtgattgttaagcttttgaaactttcagatctatgtctataaatttgtttttctctttttgcttattaggcttttgttgacacagttgaaagttaaaatcacaaggaaaagtgacagctaatcaaactgtctttgatgagctttaaaacgcctctctctttttttccttctgcagagaatatgttggaaattacattatcttttgttctttatgtcattctggtatcattctaaagcaaaaaagtgtgtgtttcttctgttcatttttctattatttcaacacatttatcatactgctataggtttgtctttaacttttctggtttcttttggttgttttgttgactttttagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgtaagtccttgaatcccttttgctaaatgcattgttgagttgttatctttgatgcttgtatatgtatttgttctttaagagttctctgttgttagagagtgactggtgaaatctctgtgttgtgtcttaggcttctgggacgaccacagacaacagctgtgagtctgtggtcgtgagtggtcagcaacgtcagcagcaaaacccaacacatcagcatcctcagcgtgatgttaacaacccagctaagtaaggaaggctctttttttgtttgtgaatttctcattgtgacattatgagaagagactaaatggagtgtttttttggtagtcttctctcgattgcggaggagaccttggcggagttcctttgcaaggctacaggaactgctgtcgactgggtccagatgattgggatgaaggtagataagttgaagtattttaacgttttcatatgtggaaatgaagtggtttttagaaaatgttttaatatgtattttcatggttatgtatgtagcctggtccggattctattggtatcgtagctgtttcacgcaactgcagtggaatagcagcacgtgcctgtggcctcgtgagtttagaacccatgaaggtaatggtgttttctttttattttaatcttgtgttgtaagaagcggaaattctacgaaggcaatctaaacttcaaatactgtgtaggtcgctgaaatcctcaaagatcgtccatcttggttccgtgactgtcgatgtgtcgagactctgaatgttatacccactggaaatggtggtactatcgagcttgtcaacactcaggtctgtttcataaatccatgagtgttgtttttgttcctttaaaatgtaatgatcattattcatggttggttatcagatttatgctcctacaacattagcagcagctcgtgacttttggacgctgagatatagtacaagtctagaagatggaagctatgtggtgggtattaggacctggttttgttcatctatgattctatttattagatttgccttatatttgcttttttgccttcaggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtaagcatattggatttgtaatagcacattaggtttcgtaaaagccttctatttatgttgattgatacgtttttttggtttggtaggtctcaagtgttcctgaagtcctcaggcctctttatgagtcttccaaaatccttgctcaaaaaatgactgtcgctgtaagttccatataaaccttatccacccgtgacctgattaggctctctttatgagttttacttccacatttcaggctctgagacatgtgcgccaaattgctcaagagactagtggagaagtccagtatagtggtggacgccagcctgcagttttaaggactttcagccagagactctgccggtaatacatttccttgataagcttagttttattttctaaagcattgttctaattgcttttcttgaaattcaggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcaggtgcctatatcatgttttgacacttgtgatagacaaaagaaccggtttcttcaatttctgacatcattctcttttttatctgctcttgaagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagaggtacaaagaatctcaagaacattttccttgttgtctattcttttgccatgcctataatcctattttgcttacttgtttctcagtttctcgaagtggttagacttggaggtcatgcttactcacctgaagacatgggcttatcccgggatatgtatttactgcaggtttgctttatactaaagacactcagggattcttaaagatgagttattgaaattgaattcttggtttcttttttgcttttgtccagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccggtaaaaagaaaactgtttatgataagaaatttgatatcttgaaattgacacagtcctttttcttttattcctgtatgtaacgttacagaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacaggtactcttcttagaaccttaatctaaagacttgtaacaatatagaatgtgcttatctcatttaataactcaataaaatgtttttctccgatgttttagtattcatacaggtgcagatctgtttggagctgattctcagtcctgtggaggagacacattgcttaagcaactctgggaccatagtgatgccatattgtgctgctccctgaaaactaatgtaagaattctgtttttttaagaggtgctcaatctagtttatggttcggtttgggaattgtctgattattttttggttctcaggcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcaggttaaacattttctagctagtcttttaagtctttccctggaaaatactaagtttggattgaatcttcttcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 536 - DNA, 4417 bp, Arabidopsis thaliana
  G390 DNA sequence used for BLAST
tcaaacaaacgaccaactaacgagggtaaaagccaagcagtggtttgattcgttgtcatcaacaactttccacaccgtcgcttgctcatacgaaaccggtctgcccatgctcgacacacatattcctgccggaagattcgcatatccctgaagaagattcaatccaaacttagtattttccagggaaagacttaaaagactagctagaaaatgtttaacctgctgcatgatcttggcgaactcggagcaaagagctctacgaccagagtcatcaagtgttttgtcgagcattatatcctgaagtgccacaagtgtagtttcaagcatgtctaaaccagcttggtttgcaaatgtgaataccggtgaggcctgagaaccaaaaaataatcagacaattcccaaaccgaaccataaactagattgagcacctcttaaaaaaacagaattcttacattagttttcagggagcagcacaatatggcatcactatggtcccagagttgcttaagcaatgtgtctcctccacaggactgagaatcagctccaaacagatctgcacctgtatgaatactaaaacatcggagaaaaacattttattgagttattaaatgagataagcacattctatattgttacaagtctttagattaaggttctaagaagagtacctgtaactacgggtgatccaacggacaagagtgagagcttcaggggaagtgggaagttgcattgagccaggacgaggcgtaatggctagagccactctctgaatcgaaccaacaacgttcctcacatactgtctcgccattgtagcaacattgtctctggaatggttatcaaacgtgaactggaaggctattgttaagaccaatctagagtttgtttccgaatcggttttggtggaaccatctagggacgatgctagatcccgtgttcgacttgcagattgatgatcattctgtaacgttacatacaggaataaaagaaaaaggactgtgtcaatttcaagatatcaaatttcttatcataaacagttttctttttaccggatttgttttttggtcgagtggtatgacacggaaaccagaaggaagcaaaggtgcatcatcagcaaatgattcatcgattggggcaaagacaagctgagcacaacctccaaccacattttcatcaacgccgctacaaagctggacaaaagcaaaaaagaaaccaagaattcaatttcaataactcatctttaagaatccctgagtgtctttagtataaagcaaacctgcagtaaatacatatcccgggataagcccatgtcttcaggtgagtaagcatgacctccaagtctaaccacttcgagaaactgagaaacaagtaagcaaaataggattataggcatggcaaaagaatagacaacaaggaaaatgttcttgagattctttgtacctcttcatgttcgagtgtctgtgcgagaggaagaatgacttggttactcgggaacccaccggttctgacgcatggaacagcatatggagttgctctgagagatgcagcagaataggcatcgacaccatagtctgcccattcagctcggtgttctctcaggaaccgaatcaatacaaggggtggaacattcttcaagagcagataaaaaagagaatgatgtcagaaattgaagaaaccggttcttttgtctattcacaagtgtcaaaacatgatataggcacctgcaacagcatagaagctttggcacagaggacaccacttccaaaacttggaagaaatgagctaccgtattgggagccagcaaatttagcagaggaagagttaatcatgatcgtaatatcctctcctccatcactactcattggagaccatccatcatcgacaaaaccatttacagcatcattgaaacccctgaatttcaagaaaagcaattagaacaatgctttagaaaataaaactaagcttatcaaggaaatgtattaccggcagagtctctggctgaaagtccttaaaactgcaggctggcgtccaccactatactggacttctccactagtctcttgagcaatttggcgcacatgtctcagagcctgaaatgtggaagtaaaactcataaagagagcctaatcaggtcacgggtggataaggtttatatggaacttacagcgacagtcattttttgagcaaggattttggaagactcataaagaggcctgaggacttcaggaacacttgagacctaccaaaccaaaaaaacgtatcaatcaacataaatagaaggcttttacgaaacctaatgtgctattacaaatccaatatgcttacatccaagtccacatgatcaacgatgtgaataatggaaccaccaccatcacaaggacggataagaaacccgcttgacagcattttggctctcacgaagcttgaagaaagtggaccattggggccaccagttgcagaagtgagtgatctctcacagacctgaaggcaaaaaagcaaatataaggcaaatctaataaatagaatcatagatgaacaaaaccaggtcctaatacccaccacatagcttccatcttctagacttgtactatatctcagcgtccaaaagtcacgagctgctgctaatgttgtaggagcataaatctgataaccaaccatgaataatgatcattacattttaaaggaacaaaaacaacactcatggatttatgaaacagacctgagtgttgacaagctcgatagtaccaccatttccagtgggtataacattcagagtctcgacacatcgacagtcacggaaccaagatggacgatctttgaggatttcagcgacctacacagtatttgaagtttagattgccttcgtagaatttccgcttcttacaacacaagattaaaataaaaagaaaacaccattaccttcatgggttctaaactcacgaggccacaggcacgtgctgctattccactgcagttgcgtgaaacagctacgataccaatagaatccggaccaggctacatacataaccatgaaaatacatattaaaacattttctaaaaaccacttcatttccacatatgaaaacgttaaaatacttcaacttatctaccttcatcccaatcatctggacccagtcgacagcagttcctgtagccttgcaaaggaactccgccaaggtctcctccgcaatcgagagaagactaccaaaaaaacactccatttagtctcttctcataatgtcacaatgagaaattcacaaacaaaaaaagagccttccttacttagctgggttgttaacatcacgctgaggatgctgatgtgttgggttttgctgctgacgttgctgaccactcacgaccacagactcacagctgttgtctgtggtcgtcccagaagcctaagacacaacacagagatttcaccagtcactctctaacaacagagaactcttaaagaacaaatacatatacaagcatcaaagataacaactcaacaatgcatttagcaaaagggattcaaggacttacagtgtggattcgatgtttcatgaatccattctcataaaccaagttggagacttgcttctgcaaacgatcattctcttccatcaaaagcttgttcatagcactcagcttcctgttcactgtctgaagacgagctgactctttcctctgcttctctcgacatctaaaaagtcaacaaaacaaccaaaagaaaccagaaaagttaaagacaaacctatagcagtatgataaatgtgttgaaataatagaaaaatgaacagaagaaacacacacttttttgctttagaatgataccagaatgacataaagaacaaaagataatgtaatttccaacatattctctgcagaaggaaaaaaagagagaggcgttttaaagctcatcaaagacagtttgattagctgtcacttttccttgtgattttaactttcaactgtgtcaacaaaagcctaataagcaaaaagagaaaaacaaatttatagacatagatctgaaagtttcaaaagcttaacaatcaccaattagaccaaaaacaagaagattaccaaaaacattgtcagacaagaacatttttgtctccaaatacaaacaaaagaaattcaattttataattacagaaacaatcaaagaacacaaaaaacattccattaaagacaattaataaagaaataataacctgcgattctggaaccaaactttgatctgtcgaggctcgatgttacagagaatgggacattcacgaataagctgttgtcttctcagagagctaggtttaggacactcagcataaactctctcaagagcttcaacttgttccggcgtgtatctaacgtacttgccggaatcaaatcctttatcaggagagtctctatcgtccatggagtgatgagccatcat

SEQ ID NO: 537 - DNA, 2559 bp, Arabidopsis thaliana
  G391 cDNA Sequence
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 538 - protein, 852 aa, Arabidopsis thaliana
  G391 Amino Acid Sequence
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 539 - DNA, 5316 bp, Arabidopsis thaliana
  G391 Genomic Sequence
agtacaaatatggacacaaagtataaattattatgagattttgcagtagatattaatttattttagctatgtaaataaaaccgtaaaagtaaaaagcttttatcaaattcaacccacctggcgtttcagttttcattttttttttacctttatgctgtttttatgttcttgcaagtctttctcgcgccacacaaaagaaaagtaatttcttttagagttatgttttattttttttggaccatgtcttaaaaggatctcgagattggcgtctgagataaagacctctactttgcttcctttatcttgctcctcttatctcttcgcttctccttcctctcctctctcgccattgccctctggcgttttctgtcttgagctaaagaaataacaaataaaccgaaaaaaataaaaatagaaacttttttttttgtttatttgttctttctccaaaactccttttttttctcaccattatctcatgaacgtgagtggaggctctctgagtagagagagcctacccttgaaaataacctagggatttctccaattttcaagctttacccattcaaaagaatcgtccttttttcctatttctgactttgagctatgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcaggtgaaatttcatcttctttccttatcaaagttgttaccttttgtctgtattaattgttttcttaccattagattatctttttgtttgtatatgagtttatgaagatgttaaatgtttttctttctttgactggtcagttgtatttaagtttccttgctgttcttatctgacaagaattttttggatctcagtgatcattttgttatgagttttaatcgtcttctaaatctctttaaagcaagaaactttgtttaccatatgctttgacgtatctagttggttgaatatctaaattcacgaaagtgacatttaatcaaattgtctttgaatgcgtttccaacatttatttctgtcaaaagcttaagattttctgccagaaattatgatatgataaaggggaaaaatttacattatcttttcttctttatatcattggatgtgttttataaagacaaatggtgtctgtctctgttcatccactaacatttcttcccatcatccatgcacatttggcttttatgttggcttagttggtctaacgaagcttccttttgatttttagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgtaaagttcacttttcactattttctgtctctaaaactcaattctatgaagcattttgtttgaaagttgttatcttttttttggaatgtaggcttctgggacgaccacagacaacagctgtgagtctgtggtcgtgagtggtcagcaacatcaacagcaaaacccaaatcctcagcatcagcaacgtgatgctaacaacccagcagggtgagcttttcttgtctgctctataactctctaatgaattctgtttcccactctgtgacaacctaaatggttcttttttgtttagactcctttctatagcagaggaggccctagcagagttcctttccaaggctacaggaactgctgttgactgggttcagatgattgggatgaaggtaatactttctggcctgaatactcttaaagttgtataatctgatttctattctttagttgtgtctgaagatgaagttgtttatgattatttgatgaaccttcattgctggtgtagcctggtccggattctattggcatagtcgctatttcgcgcaactgcagcggaattgcagcacgtgcctgcggcctcgtgagtttagaacccatgaaggtaaagagtgcgatttgttacgttctggcttgtgtttataatcattagcttacgctagtcttgatttgaaaacaaatataggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtgagttcttgaatctgctttttctgttatgtagtttctgttttaatacttttgtcttcactcactgtcttcaggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgtaagtgacaactcgaatcggttcataacacttcagttctctctttataatatgatcatgactttgttttttcggttttgcaaggcctggagtgtccctgaagtcatgaggcctctctatgaatcatcgaagattcttgctcagaaaatgactgttgctgtaagttcaaatacctttatccaaactgtatatgacctgaacgacttggtatgctgcaatgtttcttaagttcggagtcttatttcaggctttgagacatgtaagacaaattgcacaagaaacaagtggagaagttcagtatggtggagggcgccaacctgcggttttaagaaccttcagtcaaagactctgtcggtaagtatctactttacttaatagctttatcaccaagaatttcttttattcttattctaattgttcaatatggatgaactttcaggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcaggtacatgtcttaaggatttgataataaaaaaactaatattctgtttctgtctgtttctaactaacttgcatctttttttttttgtttgaagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagaggtacttttatcaaagaataacacagcttcactttctcctctctctaaatacgtgttatagtcctgaaacctttcttggttacttgtttcagtcacttgaggtggttagacttgaaggtcacgcttactcacccgaagacatgggtttagctcgggatatgtatttgctacaggtttgacttcatactttaactccaaagtttctatgctcctttgttctcttcatgacattttggattcttgattcttgtctagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccggtaacatgtcaaaaagccatttaaggatcagtcccaaatcatttattcttgacgcaatattctaaatttctaatccttcactgtcatatagaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacaggtacttcattatcattagcctctaggtttctgcttttgtttacatgatctatggagtattttatctgaatttctcttcttttctttttggctttgtagccttcacactggtgcagatctctttggatctgattctcaaaccagtggtgacacgttgctgcatcaactctggaatcactctgatgcaatcttgtgctgctccctcaaaacaaacgtaagtaacaaggcttcccattcagattttgtatttgtgactagaacatgttcttgagatgactgacataaattctcatctgtaggcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacaggtttttgttttttcttgggaaacattttgacattttcttggaaaaatcattgtttgacttggaatctaaattttgttttacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttgaagaataataagaaataagaagaccagattttactccatttttcccttggtagggaggttatttatgtaagatattaaagttaggtgccactatgctccaaagtcttttgaaattcgaggaccaatatgtaatatgacgaatgtctgatcttgtatggattgttcttgttcctatgttacgttatatggcaagattattatgataatgttatcaagttttttttcttgtgctcgtttgctttcacaaggtgactagtttctattt

SEQ ID NO: 540 - DNA, 4446 bp, Arabidopsis thaliana
  G391 DNA sequence used for BLAST
tcaaacgaacgaccaattcacgaacatgaaagctaagcagtggtttgattcatcgtcttcaagaactttccacaccgttgcctgctcgtaagataccatccttcccatgcttgacgcacatactcctgccggcagatgagcatagccctgtaaaacaaaatttagattccaagtcaaacaatgatttttccaagaaaatgtcaaaatgtttcccaagaaaaaacaaaaacctgttgcatgatcttggggaactcagagcaaagagctttacgaccaggttcgtcaagggtcttgtctagcattatgtcttgaagggctacaagagtcgtttccagcatgtctaaaccggtttggtttgcgaatgtgaaaaccggtgaagcctacagatgagaatttatgtcagtcatctcaagaacatgttctagtcacaaatacaaaatctgaatgggaagccttgttacttacgtttgttttgagggagcagcacaagattgcatcagagtgattccagagttgatgcagcaacgtgtcaccactggtttgagaatcagatccaaagagatctgcaccagtgtgaaggctacaaagccaaaaagaaaagaagagaaattcagataaaatactccatagatcatgtaaacaaaagcagaaacctagaggctaatgataatgaagtacctgtaactccgggagatccaacggaccagagtgagagcttcaggggaagtgggaacagatattggactgatattggagccaggacgaggagcaatggctagagcaaccctctgaatcgatcctactatgcttcgcacgtactgacgtgccattgaagcaacactgtctcttgaatggttatcaaatgtgaactggaatgctatggttagtaccgacctaaagttacagccatttgggtcggcttcaccagcttgacgtgtggatccttctaaagctgaggctaaatccagggtacggtttgcagatgcaccgttctatatgacagtgaaggattagaaatttagaatattgcgtcaagaataaatgatttgggactgatccttaaatggctttttgacatgttaccggagtagatttctgttcaagaggtatgatgcggaaaccggaaggaagcaaaggtgcatcatcagcaaatgattcatcgataggggcaaatacaagctgtgcacaacctccaaccacattttcatcaacaccgctacaaagctagacaagaatcaagaatccaaaatgtcatgaagagaacaaaggagcatagaaactttggagttaaagtatgaagtcaaacctgtagcaaatacatatcccgagctaaacccatgtcttcgggtgagtaagcgtgaccttcaagtctaaccacctcaagtgactgaaacaagtaaccaagaaaggtttcaggactataacacgtatttagagagaggagaaagtgaagctgtgttattctttgataaaagtacctcttcatgttcaactgtctgcgcaagaggaagaatgacttggttacttgggaaccccccagctctagcacaaggaacagcaaaaggacttgctctgagcgatgcagcagcataagcatccacgccataatcagcccattcagatcggtgttctctaaggaatcgaaccagcacagcgggtggaacgttcttcaaacaaaaaaaaaaagatgcaagttagttagaaacagacagaaacagaatattagtttttttattatcaaatccttaagacatgtacctgaagcaacatagatgccttggcacaaagcacgccactaccaaagcttggaaggaatgaattaccgtactgagacccaccaaacttcccaggggacaagtttatcattacagtaacatcctctgcaccatcgctacccattggtgaccatccatcatccacaaaaccattaacagcatcattgaaacccctgaaagttcatccatattgaacaattagaataagaataaaagaaattcttggtgataaagctattaagtaaagtagatacttaccgacagagtctttgactgaaggttcttaaaaccgcaggttggcgccctccaccatactgaacttctccacttgtttcttgtgcaatttgtcttacatgtctcaaagcctgaaataagactccgaacttaagaaacattgcagcataccaagtcgttcaggtcatatacagtttggataaaggtatttgaacttacagcaacagtcattttctgagcaagaatcttcgatgattcatagagaggcctcatgacttcagggacactccaggccttgcaaaaccgaaaaaacaaagtcatgatcatattataaagagagaactgaagtgttatgaaccgattcgagttgtcacttacatccagatcaacatgatcaacaatgtggagaatggaaccaccaccatcgcaaggacggatgagaaacccgcttggtttcatttcagctctcacaaagtttgaagaaggtggcccagtggggccaccagttgcagaagtaagcgacctttcacaaacctgaagacagtgagtgaagacaaaagtattaaaacagaaactacataacagaaaaagcagattcaagaactcaccacatagcttccatcttccaaacatgtgctatatctcagcgtccaaaagtcacgagctgctgctaaagtcgtaggagcatacatctgcgtgtaaataagctcgatcgtcccaccgtttccagcaggtatcacactcagagtatccacacttcgacaatctcggagccaagatggacgatctttgagaatttcagcaacctatatttgttttcaaatcaagactagcgtaagctaatgattataaacacaagccagaacgtaacaaatcgcactctttaccttcatgggttctaaactcacgaggccgcaggcacgtgctgcaattccgctgcagttgcgcgaaatagcgactatgccaatagaatccggaccaggctacaccagcaatgaaggttcatcaaataatcataaacaacttcatcttcagacacaactaaagaatagaaatcagattatacaactttaagagtattcaggccagaaagtattaccttcatcccaatcatctgaacccagtcaacagcagttcctgtagccttggaaaggaactctgctagggcctcctctgctatagaaaggagtctaaacaaaaaagaaccatttaggttgtcacagagtgggaaacagaattcattagagagttatagagcagacaagaaaagctcaccctgctgggttgttagcatcacgttgctgatgctgaggatttgggttttgctgttgatgttgctgaccactcacgaccacagactcacagctgttgtctgtggtcgtcccagaagcctacattccaaaaaaaagataacaactttcaaacaaaatgcttcatagaattgagttttagagacagaaaatagtgaaaagtgaactttacagtgtgaagttgatgtttcatgtggccattctcatagaccaagttagaaacttgcttctgcaaacgatcattctcttccatcaagagtttgttcatggcattgagttttctgttcactgtttgaagacgagcagcttctttcctctgcttctcacgacatctaaaaatcaaaaggaagcttcgttagaccaactaagccaacataaaagccaaatgtgcatggatgatgggaagaaatgttagtggatgaacagagacagacaccatttgtctttataaaacacatccaatgatataaagaagaaaagataatgtaaatttttcccctttatcatatcataatttctggcagaaaatcttaagcttttgacagaaataaatgttggaaacgcattcaaagacaatttgattaaatgtcactttcgtgaatttagatattcaaccaactagatacgtcaaagcatatggtaaacaaagtttcttgctttaaagagatttagaagacgattaaaactcataacaaaatgatcactgagatccaaaaaattcttgtcagataagaacagcaaggaaacttaaatacaactgaccagtcaaagaaagaaaaacatttaacatcttcataaactcatatacaaacaaaaagataatctaatggtaagaaaacaattaatacagacaaaaggtaacaactttgataaggaaagaagatgaaatttcacctgcggttctgaaaccaaactttgatctgcttaggctcgatgttagagagaatcggacattcacgtatgagttgttgtcttcttagagaacttggcttaggacactcagtgtaaactctctcgagagcttccacttgctccggcgtgtacctcacatacttgccggaatctaaccctttatccggcgactctctgttcatcatatctctgctcatcgaatggaccatcatcat

SEQ ID NO: 541 - DNA, 927 bp, Arabidopsis thaliana
  G393 cDNA Sequence
aaattttaaaggcatatttttttcatttcgactcagatgggttttgatgatacatgcaacacaggtcttgttcttggattaggtccctcaccaatttcaaataattacaatagtaccatcagacaatcctccgtttacaagctcgagccgtcgttgactctatgcctctcgggcgatccctcggttaccgtggtgaccggagctgaccagctatgccgtcagacgtcatctcacagcggagtctcttctttctcaagcgggagggtggtgaaaagagagagagacggtggcgaagagtcgccggaggaggaagagatgacggagagagttataagtgattaccatgaagatgaagaaggtattagtgctagaaaaaaacttaggcttacgaaacaacaatctgctcttcttgaggaaagcttcaaggatcatagcacccttaatcccaaacaaaagcaagttctggctagacagctgaatctaaggcctagacaagttgaagtatggtttcaaaatagaagagccaggacaaagctgaagcaaacagaagtagattgtgagtttttgaagaagtgttgtgaaacattagcagatgagaacataagacttcagaaagagattcaagaactcaaaaccctaaaattgactcagcccttttacatgcacatgcctgcatcgactctaacgaagtgtccttcttgtgagagaatcggcggcggcggcgggggtaatggaggaggaggtggcggcagcggggctaccgcggtgattgtagatggaagtacggccaaaggagctttctctatctcctcaaagcctcacttcttcaacccttttactaacccatctgcagcttgttgaatagttaattcgtttaattttattacttaaaatattaattttctttttttttttgggtggcatttt

SEQ ID NO: 542 - protein, 274 aa, Arabidopsis thaliana
  G393 Amino Acid Sequence
MGFDDTCNTGLVLGLGPSPISNNYNSTIRQSSVYKLEPSLTLCLSGDPSVTVVTGADQLCRQTSSHSGVSSFSSGRVVKRERDGGEESPEEEEMTERVISDYHEDEEGISARKKLRLTKQQSALLEESFKDHSTLNPKQKQVLARQLNLRPRQVEVWFQNRRARTKLKQTEVDCEFLKKCCETLADENIRLQKEIQELKTLKLTQPFYMHMPASTLTKCPSCERIGGGGGGNGGGGGGSGATAVIVDGSTAKGAFSISSKPHFFNPFTNPSAAC

SEQ ID NO: 543 - DNA, 1139 bp, Arabidopsis thaliana
  G393 Genomic Sequence
aggcatatttttttcatttcgactcagatgggttttgatgatacatgcaacacaggtcttgttcttggattaggtccctcaccaatttcaaataattacaatagtaccatcagacaatcctccgtttacaagctcgagccgtcgttgactctatgcctctcgggcgatccctcggttaccgtggtgaccggagctgaccagctatgccgtcagacgtcatctcacagcggagtctcttctttctcaagcgggagggtggtgaaaagagagagagacggtggcgaagagtcgccggtggaggaagagatgacggagagagttataagtgattaccatgaagatgaagaaggtattagtgctagaaaaaaacttaggcttacgaaacaacaatctgctcttcttgaggaaagcttcaaggatcatagcacccttaatcccgtaactacatatccttaatcctaattcttttttattatacgttactaatcacttttgataattcttatccaatcagattctttgttgttatattttatttacagaaacaaaagcaagttctggctagacagctgaatctaaggcctagacaagttgaagtatggtttcaaaatagaagagccaggtaaaaaaaattatattataaattatcagaatatttgattttttcatgtgtcaaaatttctttaatagtcagaaaattttgtaggtgaaaatattttctattttttaggtgatatgatttttctttcggttatatatatttaattatttattttatttaatgaatgagcaggacaaagctgaagcaaacagaagtagattgtgagtttttgaagaagtgttgtgaaacattagcagatgagaacataagacttcagaaagagattcaagaactcaaaaccctaaaattgactcagcccttttacatgcacatgcctgcatcgactctaacgaagtgtccttcttgtgagagaatcggcggcggcggcgggggtaatggaggaggaggtggcggcagcggggctaccgcggtgattgtagatggaagtacggccaaaggagctttctctatctcctcaaagcctcacttcttcaacccttttactaacccatctgcagcttgttgaatagttaattcg

SEQ ID NO: 544 - DNA, 1100 bp, Arabidopsis thaliana
  G393 DNA sequence used for BLAST
tcaacaagctgcagatgggttagtaaaagggttgaagaagtgaggctttgaggagatagagaaagctcctttggccgtacttccatctacaatcaccgcggtagccccgctgccgccacctcctcctccattacccccgccgccgccgccgattctctcacaagaaggacacttcgttagagtcgatgcaggcatgtgcatgtaaaagggctgagtcaattttagggttttgagttcttgaatctctttctgaagtcttatgttctcatctgctaatgtttcacaacacttcttcaaaaactcacaatctacttctgtttgcttcagctttgtcctgctcattcattaaataaaataaataattaaatatatataaccgaaagaaaaatcatatcacctaaaaaatagaaaatattttcacctacaaaattttctgactattaaagaaattttgacacatgaaaaaatcaaatattctgataatttataatataattttttttacctggctcttctattttgaaaccatacttcaacttgtctaggccttagattcagctgtctagccagaacttgcttttgtttctgtaaataaaatataacaacaaagaatctgattggataagaattatcaaaagtgattagtaacgtataataaaaaagaattaggattaaggatatgtagttacgggattaagggtgctatgatccttgaagctttcctcaagaagagcagattgttgtttcgtaagcctaagtttttttctagcactaataccttcttcatcttcatggtaatcacttataactctctccgtcatctcttcctcctccggcgactcttcgccaccgtctctctctcttttcaccaccctcccgcttgagaaagaagagactccgctgtgagatgacgtctgacggcatagctggtcagctccggtcaccacggtaaccgagggatcgcccgagaggcatagagtcaacgacggctcgagcttgtaaacggaggattgtctgatggtactattgtaattatttggaattggtgagggacctaatccaagaacaagacctgtgttgcatgtatcatcaaaacccat

SEQ ID NO: 545 - DNA, 1249 bp, Arabidopsis thaliana; identical to SEQ ID NO: 33
  G394 cDNA Sequence

SEQ ID NO: 546 - protein, 278 aa, Arabidopsis thaliana
  G394 Amino Acid Sequence
MGLDDSCNTGLVLGLGLSPTPNNYNHAIKKSSSTVDHRFIRLDPSLTLSLSGESYKIKTGAGAGDQICRQTSSHSGISSFSSGRVKREREISGGDGEEEAEETTERVVCSRVSDDHDDEEGVSARKKLRLTKQQSALLEDNFKLHSTLNPKQKQALARQLNLRPRQVEVWFQNRRARTKLKQTEVDCEFLKKCCETLTDENRRLQKELQDLKALKLSQPFYMHMPAATLTMCPSCERLGGGGVGGDTTAVDEETAKGAFSIVTKPRFYNPFTNPSAAC

SEQ ID NO: 547 - DNA, 1132 bp, Arabidopsis thaliana
  G394 Genomic Sequence
tacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgtcggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccgtatgatatagttaattatttccttaattaaactaatcagtctcttcttatttacgttaatcatatcgttaattactttttctatgaatttacagaagcaaaaacaagctcttgcgagacagctgaatctaaggcctagacaagttgaagtgtggttccaaaacaggagagctaggtaaatataattgattacttttgtgaattttaatatcatacttttctttctttattttggttcataaaaatattttttaattaaattttaatttgaacagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttacttattagttatttaatttctttttgttggttttttttttgtttcttaaatcaaattaggaattagttagaagataaat

SEQ ID NO: 548 - DNA, 1032 bp, Arabidopsis thaliana
  G394 DNA sequence used for BLAST
atgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccgtatgatatagttaattatttccttaattaaactaatcagtctcttcttatttacgttaatcatatcgttaattattttttctatgaatttacagaagcaaaaacaagctcttgcgagacagctgaatctaaggcctagacaagttgaagtgtggttccaaaacaggagagctaggtaaatataattgattacttttgtgaattttaatatcatacttttctttctttattttggttcataaaaatattttttaattaaattttaatttgaacagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttag

SEQ ID NO: 549 - DNA, 937 bp, Arabidopsis thaliana
  G395 cDNA Sequence
gcacaatcccactatccttcgcaagacccttcctctatataaggaagttcatttcatttggagaggacacgctgacaagctgactctagcagatctggtaccgtcgacaaggaggaagaatgcccttaggagcagctacggttgtggaggaggaagaggaggaggaggaagcggtgcctagtatgtcagtatcgccgccggatagtgtaacgtcgtcgtttcaattggactttgggattaaaagttatggttatgagagaagaagcaataagagagatattgatgatgaagtggagagatcagcctcaagagccagcaacgaagacaacgatgacgagaatggatccactaggaagaaacttagactctccaaagaccaatctgcttttcttgaagacagcttcaaagaacacagtacccttaatcctaaacagaagattgcattggcgaagcagttgaatcttcgtcctcgtcaggttgaagtctggtttcaaaacagacgagccaggacaaagctgaagcaaacggaagtggactgtgaatacctaaagagatgctgtgagtcactaaccgaagaaaaccggaggcttcaaaaagaggttaaagaattgagaaccttgaagacttccacacccttttacatgcaacttccggccactactctcactatgtgcccttcttgtgaacgtgttgccacttcagcagcacagccctccacgtcagctgcccacaacctctgtttgtccacgtcatcattgattccggttaagcctcggccggccaaacaagtttcatgaaagcacctgcgaaatacagtttgagcaaacgggcggccgctctagacaggcctcgtaccggatcctctagctagagctttcgttcgtatcatcggtttcgacaacgttcgtcaagttcaatgacatcagtttgattgcgc

SEQ ID NO: 550 - protein, 225 aa, Arabidopsis thaliana
  G395 Amino Acid Sequence
MPLGAATVVEEEEEEEEAVPSMSVSPPDSVTSSFQLDFGIKSYGYERRSNKRDIDDEVERSASRASNEDNDDENGSTRKKLRLSKDQSAFLEDSFKEHSTLNPKQKIALAKQLNLRPRQVEVWFQNRRARTKLKQTEVDCEYLKRCCESLTEENRRLQKEVKELRTLKTSTPFYMQLPATTLTMCPSCERVATSAAQPSTSAAHNLCLSTSSLIPVKPRPAKQVS

SEQ ID NO: 551 - DNA, 1169 bp, Arabidopsis thaliana
  G395 DNA sequence used for BLAST
tcatgaaacttgtttggccggccgaggcttaaccggaatcaatgatgacgtggacaaacagaggttgtgggcagctgacgtggagggctgtgctgctgaagtggcaacacgttcacaagaagggcacatagtgagagtagtggccggaagttgcatgtaaaagggtgtggaagtcttcaaggttctcaattctttaacctctttttgaagcctccggttttcttcggttagtgactcacagcatctctttaggtattcacagtccacttccgtttgcttcagctttgtcctattatcatttatcaatcacataacccccaccaacaatatgagactttgtttttgtaaagattaaagaagacgtttttttttgggttcaaattatataaagaaggattatgaatttttttctttttgtgaataagtcactataagcaattatatatggaaatgatgagcggaagtgatatactacttttgcacgaaaaatgacaaggatagacatgcgacaatttgttattattactcgtgatgcatttttcgtcctcatccctcttttcagaaattaatcatagcaaaaaaatatacttccaatgaagaaaataaaccgtttacacaggaagaaaatgaagataaataattaatgatataagctaacctggctcgtctgttttgaaaccagacttcaacctgacgaggacgaagattcaactgcttcgccaatgcaatcttctgtttctgcaatgttttagaaagaaaaaaaaaagcattaaggctaaaatttggtactaaaaaaatagaataaattcaagaaagacaaattttaaataaataaaaactgtaaagaatgggacacgaacaggattaagggtactgtgttctttgaagctgtcttcaagaaaagcagattggtctttggagagtctaagtttcttcctagtggatccattctcgtcatcgttgtcttcgttgctggctcttgaagctgatctctccacttcatcatcaatatctctcttattgcttcttctctcataaccataacttttaatcccaaagtccaattgaaacgacgacgttacactatccggcggcgatactgacatactaggcaccgcttcctcctcctcctcttcctcctccacaaccgtagctgctcctaagggcat

SEQ ID NO: 552 - DNA, 957 bp, Arabidopsis thaliana
  G396 cDNA Sequence
atgggggaaagagatgatgggttgggtttgagtctaagcttgggaaatagtcaacaaaaagaaccatctctgaggttgaatcttatgccgttgacaacttcttcttcttcttcttcgtttcaacacatgcacaatcagaataacaatagccatccccagaagattcataacatctcttggactcatctgtttcaatcttctgggattaaacgtacaactgcagagagaaactccgacgccgggtcatttctaagaggtttcaacgtgaacagagctcagtcttcggtggcggtagtggacttggaagaagaagccgccgtcgtctcgtctccaaacagcgccgtttcgagtctgagtggaaataaaagggatcttgcggtggcgagaggaggagatgaaaacgaggcggagagagcttcttgctcacgcggagggggaagcggtggtagcgacgatgaagacggcggaaacggcgacggatcaaggaagaaactacggttatcgaaggatcaagctcttgttctcgaggagacttttaaagaacatagcactcttaatccgaagcaaaagctggctctagcaaaacagttgaatctaagggcaagacaagttgaagtgtggtttcagaaccgtagggcaaggacgaagctgaaacaaacggaggttgattgtgagtatttaaagagatgttgcgataatctgaccgaggagaatcgacggctgcagaaagaagtgtcggagctgagggcgttgaagttgtctccacatctctacatgcacatgactcctcctactactctcaccatgtgcccttcttgcgaacgtgtctcctcctctgccgccactgtgaccgctgctccttccactactactactcctacggtggtggggcggccaagtccacagcgattaactccttggactgctatttctctccagcaaaaatcaggtcgctag

SEQ ID NO: 553 - protein, 318 aa, Arabidopsis thaliana
  G396 Amino Acid Sequence
MGERDDGLGLSLSLGNSQQKEPSLRLNLMPLTTSSSSSSFQHMHNQNNNSHPQKIHNISWTHLFQSSGIKRTTAERNSDAGSFLRGFNVNRAQSSVAVVDLEEEAAVVSSPNSAVSSLSGNKRDLAVARGGDENEAERASCSRGGGSGGSDDEDGGNGDGSRKKLRLSKDQALVLEETFKEHSTLNPKQKLALAKQLNLRARQVEVWFQNRRARTKLKQTEVDCEYLKRCCDNLTEENRRLQKEVSELRALKLSPHLYMHMTPPTTLTMCPSCERVSSSAATVTAAPSTTTTPTVVGRPSPQRLTPWTAISLQQKSGR

SEQ ID NO: 554 - DNA, 2040 bp, Arabidopsis thaliana
  G396 Genomic Sequence
aaagagagaggagcaggtaacagtatatatcatcattgaaattacaagggtctttctgacacaagtcatcattgaaaccccaagcaccccacataaccccttctctctattaattgtctacatatcaacttctgtgtatatatatattagtcgtgtctttaaccccattatcactacatcgattttctcgagaaagtctttcaaaatccagaaaagaaaagttctttctgttgaggacaatgggggaaagagatgatgggttgggtttgagtctaagcttgggaaatagtcaacaaaaagaaccatctctgaggttgaatcttatgccgttgacaacttcttcttcttcttcttcgtttcaacacatgcacaatcagaataacaatagccatccccagaagattcataacatctcttggactcatctgtttcaatcttctggtaatacttttctatttctcgttttaatataatgtttttttaagcattaaatgtgttgaaattctgttttatgtgcataacttcggatctatgtttcagatccgattcttttttaaataaagatatttctgttttagtaatttacgaaactgaagctaaaaacgtttttcgggttttgatgtactctagggattaaacgtacaactgcagagagaaactccgacgccgggtcatttctaagaggtttcaacgtgaacagagctcagtcttcggtggcggtagtggacttggaagaagaagccgccgtcgtctcgtctccaaacagcgccgtttcgagtctgagtggaaataaaagggatcttgcggtggcgagaggaggagatgaaaacgaggcggagagagcttcttgctcacgcggagggggaagcggtggtagcgacgatgaagacggcggaaacggcgacggatcaaggaagaaactacggttatcgaaggatcaagctcttgttctcgaggagacttttaaagaacatagcactcttaatccggttagtggcattttgtgtaatttttatctaacttataaattcagttaattacattttcgttatttgtcacttcttattgcatggacgtttgtaattggcttctctctaaaagactaaaattggtttttttttttttttttttaattatcggattgggcagaagcaaaagctggctctagcaaaacagttgaatctaagggcaagacaagttgaagtgtggtttcagaaccgtagggcaaggtaaagaaattatctttattttctaggggtattataggaaatttggtttcacagaaccttagtaattgctatgatggggatataattgtccttttatgacccaaaagcgatttcagttccctgtcctaaaagaaaatcctaataagatctctgcctctgtactgtcacatggagtttcttactttttactacagccttaaagacacatgcatgcgtatcggtacaaataaaatctacttttgtccttttttgtttcttatcagttttaaacttttatttctgttcacttcactaattaaggtgattttgatttattatttgtacgtacattaggacgaagctgaaacaaacggaggttgattgtgagtatttaaagagatgttgcgataatctgaccgaggagaatcgacggctgcagaaagaagtgtcggagctgagggcgttgaagttgtctccacatctctacatgcacatgactcctcctactactctcaccatgtgcccttcttgcgaacgtgtctcctcctctgccgccactgtgaccgctgctccttccactactactactcctacggtggtggggcggccaagtccacagcgattaactccttggactgctatttctctccagcaaaaatcaggtcgctagggaaggagtatcttcggtagttttagcttagaataaagatatgagtatgaaagtttcaaagattagcttctatctattgaaaatgaaaacaaagattagtctcaattcaaagggttcaatttgaggctctaattctgaatttgttttaacctgtaaaaggat

SEQ ID NO: 555 - DNA, 1639 bp, Arabidopsis thaliana
  G396 DNA sequence used for BLAST
ctagcgacctgatttttgctggagagaaatagcagtccaaggagttaatcgctgtggacttggccgccccaccaccgtaggagtagtagtagtggaaggagcagcggtcacagtggcggcagaggaggagacacgttcgcaagaagggcacatggtgagagtagtaggaggagtcatgtgcatgtagagatgtggagacaacttcaacgccctcagctccgacacttctttctgcagccgtcgattctcctcggtcagattatcgcaacatctctttaaatactcacaatcaacctccgtttgtttcagcttcgtcctaatgtacgtacaaataataaatcaaaatcaccttaattagtgaagtgaacagaaataaaagtttaaaactgataagaaacaaaaaaggacaaaagtagattttatttgtacgcatacgcatgcatgtgtctttaaggctgtagtaaaaagtaagaaactccatgtgacagtacagaggcagagatcttattaggattttcttttaggacagggaactgaaatcgcttttgggtcataaaaggacaattatatccccatcatagcaattactaaggttctgtgaaaccaaatttcctataatacccctagaaaataaagataatttctttaccttgccctacggttctgaaaccacacttcaacttgtcttgcccttagattcaactgttttgctagagccagcttttgcttctgcccaatccgataattaaaaaaaaaaaaaaaaaaaccaattttagtcttttagagagaagccaattacaaacgtccatgcaataagaagtgacaaataacgaaaatgtaattaactgaatttataagttagataaaaattacacaaaatgccactaaccggattaagagtgctatgttctttaaaagtctcctcgagaacaagagcttgatccttcgataaccgtagtttcttccttgatccgtcgccgtttccgccgtcttcatcgtcgctaccaccgcttccccctccgcgtgagcaagaagctctctccgcctcgttttcatctcctcctctcgccaccgcaagatcccttttatttccactcagactcgaaacggcgctgtttggagacgagacgacggcggcttcttcttccaagtccactaccgccaccgaagactgagctctgttcacgttgaaacctcttagaaatgacccggcgtcggagtttctctctgcagttgtacgtttaatccctagagtacatcaaaacccgaaaaacgtttttagcttcagtttcgtaaattactaaaacagaaatatctttatttaaaaaagaatcggatctgaaacatagatccgaagttatgcacataaaacagaatttcaacacatttaatgcttaaaaaaacattatattaaaacgagaaatagaaaagtattaccagaagattgaaacagatgagtccaagagatgttatgaatcttctggggatggctattgttattctgattgtgcatgtgttgaaacgaagaagaagaagaagaagttgtcaacggcataagattcaacctcagagatggttctttttgttgactatttcccaagcttagactcaaacccaacccatcatctctttcccccat

SEQ ID NO: 556 - DNA, 1271 bp, Arabidopsis thaliana
  G397 cDNA Sequence
tagaggcagtggcacaacatctttaagaaagagagagagaaagagtcatttattcatttcctcgcttaaaaatcttgagcacccagacagaattcttctttcttctttctggggttgagaataatgagtgaaagagatgatggattggggctaagtttgagcttgagtttaggttttaatcaaaaggacccgtcttcgaggttaaatccaatgcctctggcttcttatgcatcttcatcacacatgcagcatatgcagcagagcaattataaccatcctcaaaagattcagaacacttggattaacatgtttcagtcatcagagagaaactcggacatgagatcgtttctccggggaatagacgtgaacagagctccatcgacggtggtggttgacgtggaggatgaaggcgccggagtttcgtctccgaacagcaccgtctcaagcgtgatgagcgggaagaagagcgagcgagagctaatggctgcggcaggtgcagttggaggaggtagagtagaagataatgagattgagagagcttcttgctcgctcggcggtggtagcgacgatgaagacggtagcgggaacggagatgacagttcgaggaagaaactccgattgtctaaagaacaagctttggttcttgaagaaacttttaaagaacatagtacactcaatccgaagcaaaagatggctttggctaagcagttgaatctgaggacgagacaagttgaagtgtggttccaaaaccgaaggcaaaggacgaagctgaagcaaacggaagtagactgtgaatatcttaagagatgttgcgagaatctaacggatgagaatcggagattgcaaaaggaagtgagtgagcttagggctttaaagctttctccacacttatacatgcacatgaaacctcccactactctcacaatgtgtccttcttgcgagcgagtcgctgttacgtcatctccgtcatcggtggctcctcctgtgatgaattcatcgtctccgatgggtccgatgagtccgtgggctgccatgcctctacggcaacgacctgctgctggttctcattagagtttaattagtctaaagataataggtttggtgatttgtttttattatattgttgaacggacttggaagttcttttcaagagttggtcccatgctcttctttcctttgttttattcagtttctatttatagctgaattcaggataatggaaaatctactaatattattgtccaattattagtttggggccctgacgtagc

SEQ ID NO: 557 - protein, 315 aa, Arabidopsis thaliana
  G397 Amino Acid Sequence
MSERDDGLGLSLSLSLGFNQKDPSSRLNPMPLASYASSSHMQHMQQSNYNHPQKIQNTWINMFQSSERNSDMRSFLRGIDVNRAPSTVVVDVEDEGAGVSSPNSTVSSVMSGKKSERELMAAAGAVGGGRVEDNEIERASCSLGGGSDDEDGSGNGDDSSRKKLRLSKEQALVLEETFKEHSTLNPKQKMALAKQLNLRTRQVEVWFQNRRQRTKLKQTEVDCEYLKRCCENLTDENRRLQKEVSELRALKLSPHLYMHMKPPTTLTMCPSCERVAVTSSPSSVAPPVMNSSSPMGPMSPWAAMPLRQRPAAGSH

SEQ ID NO: 558 - DNA, 1650 bp, Arabidopsis thaliana
  G397 Genomic Sequence
aattcttctttcttctttctggggttgagaaaaatgagtgaaagagatgatggattggggctaagtttgagcttgagtttaggttttaatcaaaaggacccgtcttcgaggttaaatccaatgcctctggcttcttatgcatcttcatcacacatgcagcatatgcagcagagcaattataaccatcctcaaaagattcagaacacttggattaacatgtttcagtcatcaggtatttacctccttttactaatccagattcatgtctaagattataggtttctttgttttagatccgatctttttattacactttatcctataatagataaaattttcttgatatgtttgtgatttttaatcatttggcgtgattaacgtaacgtgcagagagaaactcggacatgagatcgtttctccggggaatagacgtgaacagagctccatcgacggtggtggttgacgtggaggatgaaggcgccggagtttcgtctccgaacagcaccgtctcaagcgtgatgagcgggaagaagagcgagcgagagctaatggctgcggcaggtgcagttggaggaggtagagtagaagataatgagattgagagagcttcttgctcgctcggcggtggtagcgacgatgaagacggtagcgggaacggagatgacagttcgaggaagaaactccgattgtctaaagaacaagctttggttcttgaagaaacttttaaagaacatagtacactcaatccggtcagtggcatttccgtagttttcttcaataggttgactttttatatgtttttcattgactttttttgttgttgttggatgcagaagcaaaagatggctttggctaagcagttgaatctgaggacgagacaagttgaagtgtggttccaaaaccgaaggcaaaggtagaaatttttattctattttaaggggttactttcgtaaattttatatagtccaacaaatagaacattagtagttattgctatgatggtgatatgtgtaatggtccattttatgacccataagattatcctaaaggattttaatgggtctctcatgtcttaaatttaggaggtttggtttaagctattcagttttcccggtttaagaattaaaaccgccaatgttgtttttgagtcaaattttggttaaagtgttttcagttttccggttcaagaacaataaccgccagtttcgaatacaagaaacaaatgtacttcgggttttctctttcccggatagttaaaccggatatcggattttaatgttttggactgtttgtgtgtgtgtttataggacgaagctgaagcaaacggaagtagactgtgaatatcttaagagatgttgcgagaatctaacggatgagaatcggagattgcaaaaggaagtgagtgagcttagggctttaaagctttctccacacttatacatgcacatgaaacctcccactactctcacaatgtgtccttcttgcgagcgagtcgctgttacgtcatctccgtcatcggtggctcctcctgtgatgaattcatcgtctccgatgggtccgatgagtccgtgggctgccatgcctctacggcaacgacctgctgctggttctcattagagtttaattagtctaaagataataggtttggtg

SEQ ID NO: 559 - DNA, 1583 bp, Arabidopsis thaliana
  G397 DNA sequence used for BLAST
ctaatgagaaccagcagcaggtcgttgccgtagaggcatggcagcccacggactcatcggacccatcggagacgatgaattcatcacaggaggagccaccgatgacgaagatgacgtaacagcgactcgctcgcaagaaggacacattgtgagagtagtgggaggtttcatgtgcatgtataagtgtggagaaagctttaaagccctaagctcactcacttccttttgcaatctccgattctcatccgttagattctcgcaacatctcttaagatattcacagtctacttccgtttgcttcagcttcgtcctataaacacacacacaaacagtccaaaacattaaaatccgatatccggtttaactatccgggaaagagaaaacccgaagtacatttgtttcttgtattcgaaactggcggttattgttcttgaaccggaaaactgaaaacactttaaccaaaatttgactcaaaaacaacattggcggttttaattcttaaaccgggaaaactgaatagcttaaaccaaacctcctaatttaagacatgagagacccattaaaatcctttaggataatcttatgggtcataaaatggaccattacacatatcaccatcatagcaataactactaatgttttatttgttggactatataaaatttacgaaagtaaccccttaaaatagaataaaaatttctaccttgcccttcggttttggaaccacacttcaacttgtctcgtcctcagattcaattgcttagccaaagccatcttttgcttctgcatccaacaacaacaaaaaaagtcaatgaaaaacatataaaaagtcaacctattgaagaaaactacggaaatgccactgaccggattgagtgtactatgttctttaaaagtttcttcaagaaccaaagcttgttctttagacaatcggagtttcttcctcgaactgtcatctccgttcccgctaccgtcttcatcgtcgctaccaccgccgagcgagcaagaagctctctcaatctcattatcttctactctacctcctccaactgcacctgccgcagccattagctctcgctcgctcttcttcccgctcatcacgcttgagacggtgctgttcggagacgaaactccggcgccttcatcctccacgtcaaccaccaccgtcgatggagctctgttcacgtctattccccggagaaacgatctcatgtccgagtttctctctgcacgttacgttaatcacgccaaatgattaaaaatcacaaacatatcaagaaaattttatctattataggataaagtgtaataaaaagatcggatctaaaacaaagaaacctataatcttagacatgaatctggattagtaaaaggaggtaaatacctgatgactgaaacatgttaatccaagtgttctgaatcttttgaggatggttataattgctctgctgcatatgctgcatgtgtgatgaagatgcataagaagccagaggcattggatttaacctcgaagacgggtccttttgattaaaacctaaactcaagctcaaacttagccccaatccatcatctctttcactcat

SEQ ID NO: 560 - DNA, 1201 bp, Arabidopsis thaliana
  G398 cDNA Sequence
agaaggtttctcttgtcctccatacacttagcacaactgataaatcttttgaggtaaaatcagctttagatcaaggtttttctagtcatctctactcataaagatcaaagcttttgctattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccaaacagaagctggctttggctaagaagctaggtttaacagcaagacaagtggaagtgtggttccaaaacagaagagcaaggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgtactttttagattattgactctcagctaatgtatccttaaaagcctttttctacttttaaatttactttaatctaattaaattagttgtccatgtcttcttgataacaaaaaaatttataattataaaaaaaaaaaacaggataaaaaaaaaaaaaaaaaaaaaaaa

SEQ ID NO: 561 - protein, 282 aa, Arabidopsis thaliana
  G398 Amino Acid Sequence
MMMGKEDLGLSLSLGFAQNHPLQLNLKPTSSPMSNLQMFPWNQTLVSSSDQQKQQFLRKIDVNSLPTTVDLEEETGVSSPNSTISSTVSGKRRSTEREGTSGGGCGDDLDITLDRSSSRGTSDEEEDYGGETCRKKLRLSKDQSAVLEDTFKEHNTLNPKQKLALAKKLGLTARQVEVWFQNRRARTKLKQTEVDCEYLKRCVEKLTEENRRLEKEAAELRALKLSPRLYGQMSPPTTLLMCPSCERVAGPSSSNHNQRSVSLSPWLQMAHGSTFDVMRPRS

SEQ ID NO: 562 - DNA, 1191 bp, Arabidopsis thaliana
  G398 Genomic Sequence
tattctcattttctaccaagagacaatatcatgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcaggtaagcttcttcttcaacaaagtcttgataacctttttccacaaggaaacaacacagatcctgaaataaccctttttcatttttcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccgttagtcattcatccatctctcggagcgtgaaagtattattgtaaatactctgtttttaacaagggctttattgtaaaactacagaaacagaagctggctttggctaagaagctaggtttaacagcaagacaagtggaagtgtggttccaaaacagaagagcaaggtgagagaactagagtgctcattatttttacatattagttgaccattttgcccctaaagagcaatgttatttacaatacaacccatttttgtgcctaataggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaactttaatgctgcttctatgggttgtgtgtgggtcattgt

SEQ ID NO: 563 - DNA, 1122 bp, Arabidopsis thaliana
  G398 DNA sequence used for BLAST
atgatgatgggtaaagaggatttgggtttaagtcttagcttgggatttgcacaaaaccatcctctccagctaaatcttaaacccacttcttcaccaatgtccaatctccagatgtttccatggaaccaaacccttgtttcttcctcaggtaagcttcttcttcaacaaagtcttgataacctttttccacaaggaaacaacacagatcctgaaataaccctttttcatttttcagatcaacaaaagcaacagtttcttaggaaaatcgacgtgaacagcttgccaacaacggtggatttggaagaggagacaggagtttcgtctccaaacagtacgatctcgagcacagtgagtggaaagaggaggagtactgaaagagaaggtacctccggtggtggttgcggagatgaccttgacatcactctagatagatcttcctcacgtggaacctccgatgaagaggaagattacggaggtgagacttgtaggaagaagcttagactatccaaagatcaatccgcagttctcgaagacactttcaaagagcacaatactctcaatcccgttagtcattcatccatctctcggagcgtgaaagtattattgtaaatactctgtttttaacaagggctttattgtaaaactacagaaacagaagctggctttggctaagaagctaggtttaacagcaagacaagtggaagtgtggttccaaaacagaagagcaaggtgagagaactagagtgctcattatttttacatattagttgaccattttgcccctaaagagcaatgttatttacaatacaacccatttttgtgcctaataggacaaagttaaagcagaccgaagtggattgcgagtatttgaaaagatgtgttgagaaattaacggaagagaatcggcggctcgagaaagaggcagcggaactaagagcattaaagctttcaccgcggttgtatggtcagatgagtccaccgaccacacttttgatgtgtccatcgtgtgaacgtgtggccggaccatcctcatctaaccacaaccagcgatctgtctcattgagtccatggctccaaatggcccatgggtcaacctttgatgtgatgcgtcctaggtcttaa

SEQ ID NO: 564 - DNA, 977 bp, Arabidopsis thaliana
  G399 cDNA Sequence
aggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtgggtggcccatcatcatcgaaccatcaccacaatcacaggcccgtttctatcaatccgtgggttgcttgtgctggtcaggtggctcatgggctgaattttgaagccttgcgtccacgatcgtgattttttattttagtggtgggaaaagggtgttttggtatttttcgttatcgttatatagtctatctgtgtggggtcattgttattttggatgattggccttctcatgaacta

SEQ ID NO: 565 - protein, 283 aa, Arabidopsis thaliana
  G399 Amino Acid Sequence
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVGGPSSSNHHHNHRPVSINPWVACAGQVAHGLNFEALRPRS

SEQ ID NO: 566 - DNA, 764 bp, Arabidopsis thaliana
  G399 DNA sequence used for BLAST
tcacctagctcttctgttttggaaccacacttccacttgtcttgccgtcaagttcagcttcttagccaaagctagcttctgtttctgtaaattatgataataaccttggttatttcaaagtaattacgataattatcatttgattcctctgacttttttacacttacgggattgagagtgttgtgttctttgaaagtctcttcgagaaaagcagactgatcttttgataacctgagcttcttcctcgacgtttcgcccccgtcttcttcttcatctgaggttccacgtgagtaccctcgatccggagtgatctcgtcgtgatcgtcgccggagccaacgccggttccggagattccttctctctcacttctcttcccgctaatggtgcttgagatcgtactgtttggtgacgaaactcctgtgtcttcctcgcagttaaccgttgatggaaaactgttcacgtctatcttgcgaagatctgcaaagagcaatcaaattttaagtttgagatctgtttttattttacttggaaacgaagaaaagtctcatacttcaattctgaaatctgttctgtttctttaaaaaaaaaaacagagaagatttaagtatatacctgatgtaggatcgaatgtttggttccatgggagtctctggagattgtttgataatgaagagttaggattcagattcatctgaagaggattgtgattttgtgaaaaccctaagcttaggctcaaacctagatcttctttgcccatcatcat

SEQ ID NO: 567 - DNA, 1176 bp, Arabidopsis thaliana
  G400 cDNA Sequence
cttcaactgctgcgtctagctgtccttccttcttcatttgcttcttcttctctagctcagcgcggatcgctgcagtagtaccctgacgtagcctttcttcttcctttactttctcatcttctatctctcaaaagaaaagcagacaactttatttgcaaaaacagagtttttttttcttatcttgagaaagttcaacagaagatgatgttcgagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcagttccaaactcagattcgtcacaaaaagaaacaagaactttcatccgaggaatcgacgtgaacagaccaccgtctacagcggaatacggcgacgaagacgctggagtatcttcacctaacagtacagtctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccgaagcagaagcaagcattggctaaacaattagggttacgagcaagacaagtggaagtttggtttcagaacagacgagcaagaacaaagctgaagcaaacggaggtagactgcgagttcttacggagatgctgcgagaatctaacggaagagaaccgtcggctacaaaaagaagtaacggaattgagagtacttaagctctctcctcagttctacatgcacatgagcccacccactactttgaccatgtgcccttcatgtgaacacgtgtcggtcccgccaccacaacctcaggctgctacgtcagcgcaccaccggtcgttgccggtcaatgcgtgggctcctgctacgaggatatctcacggcttgacttttgacgctcttcgtcctaggtcctaagtctttttacttgcaaccaaagggcattttggtcgttttttaagtttcatggaccagatatgcatgtagttgttaacatgtatgtattttcttagaaagaaagaaaaacagattaatatt

SEQ ID NO: 568 - protein, 284 aa, Arabidopsis thaliana
  G400 Amino Acid Sequence
MMFEKDDLGLSLGLNFPKKQINLKSNPSVSVTPSSSSFGLFRRSSWNESFTSSVPNSDSSQKETRTFIRGIDVNRPPSTAEYGDEDAGVSSPNSTVSSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTEENRRLQKEVTELRVLKLSPQFYMHMSPPTTLTMCPSCEHVSVPPPQPQAATSAHHRSLPVNAWAPATRISHGLTFDALRPRS

SEQ ID NO: 569 - DNA, 1314 bp, Arabidopsis thaliana
  G400 DNA sequence used for BLAST
atgatgttcgagaaagacgatctgggtctaagcttaggcttgaattttccaaagaaacagatcaatctcaaatcaaatccatctgtttctgttactccttcttcttcttcttttggattattcagaagatcttcatggaacgagagttttacttcttcaggtacttcatcgctttcttcgttcctctgtttttttttatttttccccggaaaaaaccttaaaggtctcaccttttactctacttttcaatcttatgcatgcagttccaaactcagattcgtcacaaaaagaaacaagaactttcatccgaggaatcgacgtgaacagaccaccgtctacagcggaatacggcgacgaagacgctggagtatcttcacctaacagtacagtctcaagctctacagggaaaagaagcgagagagaagaagacacagatccacaaggctcaagaggaatcagtgacgatgaagatggtgataactccaggaaaaagcttagactttccaaagatcaatctgctattcttgaagagaccttcaaagatcacagtactctcaatccggtaatttttttcttcttttacttattgtttcacccgagaaagtttggttttactgggaaaattaatggctatgataaattgtggaaacgaaaaaagaacgcgttaatgaaatattcacattaaaatgactattgttacatgttgaccaaagaaaaaacattactactactatttgtttcggtctctcataaatgcagatattaatttataaatggcattttggtaaatgtagactgatatcaaggtttttttcaactttttttcacagaagcagaagcaagcattggctaaacaattagggttacgagcaagacaagtggaagtttggtttcagaacagacgagcaaggtaaataaaacacacacaaacaaaagatctctctatttgcctgatttatctattttcttataagggtattttggtaaatgtttaacagaacaaagctgaagcaaacggaggtagactgcgagttcttacggagatgctgcgagaatctaacggaagagaaccgtcggctacaaaaagaagtaacggaattgagagcacttaagctctctcctcagttctacatgcacatgagcccacccactactttgaccatgtgcccttcatgtgaacacgtgtcggtcccgccaccacaacctcaggctgctacgtcagcgcaccaccggtcgttgccggtcaatgcgtgggctcctgcgacgaggatatctcacggcttgacttttgacgctcttcgtcctaggtcctaa

SEQ ID NO: 570 - DNA, 1553 bp, Arabidopsis thaliana
  G404 cDNA Sequence
ccgggattccgggaaaataataatacgacttttgaaatctctcactaatatttcccaagaaaacctgatgaattaaaagttcatattttcttggtgttgattggtattagatgactatttcttagtattagtcaattctctgtttccatcttatatggatagtctagacacagagcaaagatccttctttggagaaaaagaagatgagagacgagagaggatcgtttcttcacgtattggtcgtagatagatcttaatcgataaccatctaggccttgatctaaccattcaatataaactttatttccttcttcttttcgatctcaattgttccgaccaaacaagatgaagagatcacgtggaagctccgattctttatccggtttcttaccaattcgccattctacaacagacaaacaaataagcccaagaccaacaactaccggctttctctattccggcgccggagactactcccagatgtttgacgcattagaagacgacggaagtctagaggacctcggcggcgttggacacgcgtcttctacggcggcggagaaaaaacggcggttgggtgtagagcaagtgaaagcgttagagaagaatttcgagattgataacaagttagagccagagaggaaagtgaagctggctcaagagcttgggttgcagccacgccaagtcgcgatctggtttcaaaaccgccgtgctcggtggaagacaaagcagcttgaacgtgattacggcgttcttaagtcaaactttgatgcactcaaacgcaaccgcgactcgcttcaacgcgataacgattcactccttggacagattaaagagctgaaagcaaaacttaacgtggaaggggttaaaggtatagaagagaacggcgctttaaaagcagtggaagcaaatcaatcggtgatggctaataatgaagtcttagagctaagccaccgttctccatcgccaccaccgcatattcctacggacgctccgacatcggagctcgcattcgaaatgtttagcatttttccacgcacggaaaacttcagagacgatcctgccgatagcagcgactcaagcgcggttttgaacgaagagtatagtcccaatacggttgaagcagctggcgcagtggcggccacgactgtagaaatgtcgacgatgggttgttttagccaattcgtgaaaatggaagagcatgaagatctgtttagtggagaggaagcttgcaagttgtttgcggacaatgagcaatggtattgctccgatcagtggaattcgtaaaatgtgggggcagaattaaaagcatagaaaagctgaagggggtatgtggaaatattactgaagtcatattgggtcggaaaatgcattactcaaaatattggggtttttcttgagaaaatggaatatgacgcgagagggtagtaaaaacgagcgtgtggcgttccatgcacgtgtggccgtaatcttttcaaggttgaatgagagaggacaaaaaagtctgaaatcatcgggaataaaaaaaatatgtgacgaagaaaaaaaaaaaaaaa

SEQ ID NO: 571 - protein, 312 aa, Arabidopsis thaliana
  G404 Amino Acid Sequence
MKRSRGSSDSLSGFLPIRHSTTDKQISPRPTTTGFLYSGAGDYSQMFDALEDDGSLEDLGGVGHASSTAAEKKRRLGVEQVKALEKNFEIDNKLEPERKVKLAQELGLQPRQVAIWFQNRRARWKTKQLERDYGVLKSNFDALKRNRDSLQRDNDSLLGQIKELKAKLNVEGVKGIEENGALKAVEANQSVMANNEVLELSHRSPSPPPHIPTDAPTSELAFEMFSIFPRTENFRDDPADSSDSSAVLNEEYSPNTVEAAGAVAATTVEMSTMGCFSQFVKMEEHEDLFSGEEACKLFADNEQWYCSDQWNS

SEQ ID NO: 572 - DNA, 1761 bp, Arabidopsis thaliana
  G404 DNA sequence used for BLAST
ttacgaattccactgatcggagcaataccattgctcattgtccgcaaacaacttgcaagcttcctctccactaaacagatcttcatgctcttccattttcacgaattggctaaaacaacccatcgtcgacatttctacagtcgtggccgccactgcgccagctgcttcaaccgtattgggactatactcttcgttcaaaaccgcgcttgagtcgctgctatcggcaggatcgtctctgaagttttccgtgcgtggaaaaatgctaaacatttcgaatgcgagctccgatgtcggagcgtccgtaggaatatgcggtggtggcgatggagaacggtggcttagctctaagacttcattattagccatcaccgattgatttgcttccactgcttttaaagcgccgttctcttctatacctttaaccccttccacgttaagttttgctttcagctctttaatctgcataaatgtcatgttttataaatatcaatactctttataatctaccaaacaaaaggattatctctgaatttgtttaaatttagctattattatcccaaattatataataaattaataaacatgaaacttttagtatattaatcacaaaattcaaaaaaaaaatctgtttgtgtttggtttatcatttgtaattagcttaaaatgatatttttaacaaatgatattagcttaaaatgcataagtttgtgacttttttatacactaaagaaaaatcaacgtaattaaaggcaattcaaacacagacgatcaaaactttagtctaacggtcagaattcaaattgtaatttcaaaataaacaaattgaaacgatgttattaatgttctatacgttcgtttatttgattgaccgaatcattgatggatttagttacaataatggctaagatggttgtttgggtgtgcctagacgtttaaatttattgacaaaaaaaaaagtcacaaagactatacctgtccaaggagtgaatcgttatcgcgttgaagcgagtcgcggttgcgtttgagtgcatcaaagtttgacttaagaacgccgtaatcacgttcaagctgctttgtcttccaccgagcacggcggttttgaaaccagatcgcgacttggcgtggctgcaacccaagctcttgagccagcttcactttcctctctggctctaacttgttatcaatctcgaaattcttctctaacgctttcacttgctctacacccaaccgccgttttttctccgccgccgtagaagacgcgtgtccaacgccgccgaggtcctctagacttccgtcgtcttctaatgcgtcaaacatctgggagtagtctccggcgccggaatagagaaagccggtagttgttggtcttgggcttatttgtttgtctgttaaaatcattaatcaaggtagtacattaaaaatagtactactatatatctaaccaatctcataaaacggatagtttcaatcaaataatggaatatttatgatgtcatgagtaatcacaaaaccttgtcaggataacgtctcgatagtatgaattgtcagaaaacatatatttacttaaaatgttaattaataaaacacaatcatataataaaaaaattcattagtatctttctaatgatcatcaacaaacataattgcagtttcagaattgtataagagtttatattacaagagtcttattttacctgttgtagaatggcgaattggtaagaaaccggataaagaatcggagcttccacgtgatctcttcat

SEQ ID NO: 573 - DNA, 1302 bp, Arabidopsis thaliana; identical to SEQ ID NO: 8
  G409 cDNA Sequence

SEQ ID NO: 574 - protein, 272 aa, Arabidopsis thaliana
  G409 Amino Acid Sequence
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 575 - DNA, 1387 bp, Arabidopsis thaliana
  G409 DNA sequence used for BLAST
ctaaggccatccccagaaagccaatgattcaccgtgatgatcgtgcgacggtgaagtggtgggcacaaagacgtcggcgaaacagctccggtcattgtcatgatcactggcgttgctgttgtcttggatgggtacgatgcttgggaagtaagagtcacagctgtctagtagttgaggtgcgtcgtcgtctagtaccgcgctcccaacgctccctgaacttaaccggtcctcggttttgattgctgccgcattaatgtaaaccggatcaagttggtttggttcgggcacttgaccaggtggttcattagctgtctcttgtttgccctgaagcttttcggtcagggaagtaacctgtcgggttggaaagattctaactttaatcacaacggtcaacacaagcaacctcctcccataaaaagataattaaactcgttgattgatttgattccccaattttctttctttttctagtctctcctctaatttatatatatatgatgatggattctctctatcagcttgtgttgaaaaataggaaaagcatattctcttttcacttgatgctttttttatttttctcctttggaccaattaaggtaaatcattcaatttgtaatcttgttgagataaataatagtcccatgtataagtacctcggatctgagcttatcgttgtccatgacgatggagtcgtagttagaaagaagttggtcgtaagtggacttgagaagatcgtagtctctctcaagctgttttgttttccaacgagctcggcgattctgaaaccagacagccacttgccttggctgtagaccaagcttcttggcaagctgagtcttgcgttcaggctctagcttgttctctgtctcgaagcttttctccagcagatgcaccttttaccataatataatgagaatctatcaaacttgtttttgaatagtggatcgttaattattattgtggatagtgagagaatctacttgttcggtagtgaggcgacgcttcttttcaggcaactggtcgtcgtaaaagtcatcgtcgtagagatcctcaggggagctaaagaagggccttcgcttcgaagtttcctccatgttcatcatcgatcttgctcctcctccttcacaaattcaaacgaacaactgctgtcaataatcgaatgaggtattcatattcaaattggttctcatgtgtgtgtatgtgtgttcctaacgttttatacacaaaaacaggggaaattcaccgaaaagtaatgtgttccaagatgatgaaataagattaagagagtgagaaaagaaccttggacgacgggattgagattcccaaggaagaacatgctgttgccgtgtgaagcagatggatcgaagaaaaacgaattggattccat

SEQ ID NO: 576 - DNA, 882 bp, Arabidopsis thaliana
  G411 cDNA Sequence
atggcctttcctcaacatggcttcatgtttcagcaactccatgaagacaatgctcatcacttaccttccccaacctctctcccctcttgtcctcctcatctcttctatggaggaggaggaaactacatgatgaacagatcaatgtcgttcacgggagtatcagatcattatcatctaactcaaaaaagcccgacaacaacgaacaacatgaatgatcaagaccaggtaggcgaggaagacaacctatcagacgatgggtcacatatgatgttaggagagaagaagaagaggctgaatttagagcaagttagggcattagagaagagcttcgagctagggaacaagctggagccagagaggaagatgcagcttgctaaggctttaggattgcagcctaggcagattgcaatatggtttcagaacaggagagctaggtggaagacaaagcagctcgagagagactatgattctctcaaaaaacagttcgatgttttgaaatcggacaatgattctcttcttgcccacaacaagaaactacatgctgagttagtggcattgaagaaacacgaccgtaaagaatcagcaaagatcaagagagaattcgcagaagcttcatggagcaacaatgggagcacagaaaataatcataacaataatagttcagacgctaatcatgtgagcatgatcaaagatcttttcccttcttcgatccgatccgcgaccgcgaccacggcctctacccatattgatcatgagattgttcaagatcaagatcaagggttttgcaatatgttcaatggtattgatgaaacgacgtcggctagttattgggcatggcctgaccagcagcaacaacatcacaatcatcatcagttcaattga

SEQ ID NO: 577 - protein, 293 aa, Arabidopsis thaliana
  G411 Amino Acid Sequence
MAFPQHGFMFQQLHEDNAHHLPSPTSLPSCPPHLFYGGGGNYMMNRSMSFTGVSDHYHLTQKSPTTTNNMNDQDQVGEEDNLSDDGSHMMLGEKKKRLNLEQVRALEKSFELGNKLEPERKMQLAKALGLQPRQIAIWFQNRRARWKTKQLERDYDSLKKQFDVLKSDNDSLLAHNKKLHAELVALKKHDRKESAKIKREFAEASWSNNGSTENNHNNNSSDANHVSMIKDLFPSSIRSATATTASTHIDHEIVQDQDQGFCNMFNGIDETTSASYWAWPDQQQQHHNHHQFN

SEQ ID NO: 578 - DNA, 1596 bp, Arabidopsis thaliana
  G411 Genomic Sequence
atggcctttcctcaacatggcttcatgtttcagcaactccatgaagacaatgctcatcacttaccttccccaacctctctcccctcttgtcctcctcatctcttctatggtaagtacctctctccctcttaccaaaatttgattacaaatttatcaattttccgtttgatgtttggtcactttggaattcactgcgttattaccttgaaatcccaagttaccaaaagaagcaataattggtaatttttgttgtctttgttttggtgtaggaggaggaggaaactacatgatgaacagatcaatgtcgttcacgggagtatcagatcatcatcatctaactcaaaaaagcccgacaacaacgaacaacatgaatgatcaagaccaggtaggcgaggaagacaacctatcagacgatgggtcacatatgatgttaggagagaagaagaagaggctgaatttagagcaagttagggcattagagaagagcttcgagctagggaacaagctggagccagagaggaagatgcagcttgctaaggctttaggattgcagcctaggcagattgcaatatggtttcagaacaggagagctaggtggaagacaaagcagctcgagagagactatgattctctcaaaaaacagttcgatgttttgaaatcggacaatgattctcttcttgcccacaacaagaaactacatgctgaggtatataatatacacacaaattctactaatcgttgaacatcgcgttagtttttaagcgctaatcttatcgaaacgattttcgattagattgataagaaatgtttttacaaatcactaattaatatgaatattatatgtacgaattcttcgtggtctatacgatgaaaaaataatgtgtattgatatatagctcgtagaattatagctaatgaattattattatcattaatcaagcatatacaaaaggaaaaccttcatggattaacacgtagtgtgagatcttagaatagctttaagatatagtatatagtatgatatcatttgcaattagattaatgataggctcttgatccaacgcaaagatgtttgtcaaaagacattaattataaattcttttctattttcaaataaagattcttacattttaaattagtaaacttcccatgtgctcgtggagttgacattacgataatttatgttatttaacaaattaataaatttatatgtgaataaatctctccactaacgtgtgataatattgctacataaaacagttagtggcattgaagaaacacgaccgtaaagaatcagcaaagatcaagagagaattcgcagaagcttcatggagcaacaatggaagcacagaaaataatcataacaataatagttcagacgctaatcatgtgagcatgatcaaagatcttttcccttcttcgatccgatccgcgaccgcgaccacgacctctacccatattgatcatcagattgttcaagatcaagatcaagggttttgcaatatgttcaatggtattgatgaaacgacgtcggctagttattgggcatggcctgaccagcagcaacaacatcacaatcatcatcagttcaattga

SEQ ID NO: 579 - DNA, 1596 bp, Arabidopsis thaliana
  G411 DNA sequence used for BLAST
tcaattgaactgatgatgattgtgatgttgttgctgctggtcaggccatgcccaataactagccgacgtcgtttcatcaataccattgaacatattgcaaaacccttgatcttgatcttgaacaatctgatgatcaatatgggtagaggtcgtggtcgcggtcgcggatcggatcgaagaagggaaaagatctttgatcatgctcacatgattagcgtctgaactattattgttatgattattttctgtgcttccattgttgctccatgaagcttctgcgaattctctcttgatctttgctgattctttacggtcgtgtttcttcaatgccactaactgttttatgtagcaatattatcacacgttagtggagagatttattcacatataaatttattaatttgttaaataacataaattatcgtaatgtcaactccacgagcacatgggaagtttactaatttaaaatgtaagaatctttatttgaaaatagaaaagaatttataattaatgtcttttgacaaacatctttgcgttggatcaagagcctatcattaatctaattgcaaatgatatcatactatatactatatcttaaagctattctaagatctcacactacgtgttaatccatgaaggttttccttttgtatatgcttgattaatgataataataattcattagctataattctacgagctatatatcaatacacattattttttcatcgtatagaccacgaagaattcgtacatataatattcatattaattagtgatttgtaaaaacatttcttatcaatctaatcgaaaatcgtttcgataagattagcgcttaaaaactaacgcgatgttcaacgattagtagaatttgtgtgtatattatatacctcagcatgtagtttcttgttgtgggcaagaagagaatcattgtccgatttcaaaacatcgaactgttttttgagagaatcatagtctctctcgagctgctttgtcttccacctagctctcctgttctgaaaccatattgcaatctgcctaggctgcaatcctaaagccttagcaagctgcatcttcctctctggctccagcttgttccctagctcgaagctcttctctaatgccctaacttgctctaaattcagcctcttcttcttctctcctaacatcatatgtgacccatcgtctgataggttgtcttcctcgcctacctggtcttgatcattcatgttgttcgttgttgtcgggcttttttgagttagatgatgatgatctgatactcccgtgaacgacattgatctgttcatcatgtagtttcctcctcctcctacaccaaaacaaagacaacaaaaattaccaattattgcttcttttggtaacttgggatttcaaggtaataacgcagtgaattccaaagtgaccaaacatcaaacggaaaattgataaatttgtaatcaaattttggtaagagggagagaggtacttaccatagaagagatgaggaggacaagaggggagagaggttggggaaggtaagtgatgagcattgtcttcatggagttgctgaaacatgaagccatgttgaggaaaggccat

SEQ ID NO: 580 - DNA, 654 bp, Arabidopsis thaliana
  G412 cDNA Sequence
atgaactacacggtggatgatcagaacatggcttttatctctcaactgtaccctgatgtctacactcagatagtacaaccagtaggagaagtgaagcagccgaagcggaggaggaagaagaccaaaggatccgtggcttccgcagatggaggcaacggtttgtttagaaagaggaagctgaccgatgaacaagtgaacatgttggagatgagttttggggatgaacacaaacttgagtcggagaggaaagatagacttgcggcagagctagggcttgaccctcgtcaagttgccgtttggtttcagaaccgtcgcgcacggtggaagaacaaaaggctcgaggaagagtacaataaactcaagaactcacatgataacgtcgttgtcgacaagtgccgacttgaatctgaggttattcagctcaaagaacaactctatgatgcagagagggaaatccaaagattagcagaaagagtagaaggaggctcaagcaacagtccaatttcgtcttccgtttccgtcgaagctaatgaaacgccattttttggagactataaagtcggagatgatggcgatgactatgatcacttgttttatccggtgccggaaaatagttacatcgatgaagcggaatggatgagtctatacatataa

SEQ ID NO: 581 - protein, 217 aa, Arabidopsis thaliana
  G412 Amino Acid Sequence
MNYTVDDQNMAFISQLYPDVYTQIVQPVGEVKQPKRRRKKTKGSVASADGGNGLFRKRKLTDEQVNMLEMSFGDEHKLESERKDRLAAELGLDPRQVAVWFQNRRARWKNKRLEEEYNKLKNSHDNVVVDKCRLESEVIQLKEQLYDAEREIQRLAERVEGGSSNSPISSSVSVEANETPFFGDYKVGDDGDDYDHLFYPVPENSYIDEAEWMSLYI

SEQ ID NO: 582 - DNA, 1666 bp, Arabidopsis thaliana
  G412 Genomic Sequence
atgaactacacggtggatgatcagaacatggcttttatctctcaactgtaccctgatgtctacactcagatagtacaaccaggtttgtccttttttgtaattagtttgttcgaaatttcatacctttttatttaaaagttcgacaaaacccaaaattcatggattttcttataaaaatagaagtgggttttgtttttagttttaatttgtccgaagttctttatcccctcacaaattttgtggaagaagttatatataagaattcaagtggattatgttatgtgcatgagtctttaaaagaaaaaaagttctcgactaatacgcataagcctagttaaaatcttggtatcatctacgtgcatgtgaagtgtgaacacacatcaagaacaatctaaactttatttaagatgtttctgcttttggtcagtaggagaagtgaagcagccgaagcggaggaggaagaagaccaaaggatccgtggcttccgcagatggaggcaacggtttgtttagaaagaggaagctgaccgatgaacaagtgaacatgttggagatgagttttggggatgaacacaaacttgagtcggagaggaaagatagacttgcggcagagctagggcttgaccctcgtcaagttgccgtttggtttcagaaccgtcgcgcacggtggaagaacaaaaggctcgaggaagagtacaataaactcaagaactcacatgataacgtcgttgtcgacaagtgccgacttgaatctgaggtatttcttatttttaatgtttcaattacttcttctttttttccatttcatgctctacttttttttttttttttttttcttgctctattctttttttcattatgaatataataaatatgggtagagataatgattacttaagggatatattaaaaaactttttccaatccaaattttaaatctacatagataattaaggaaaatgctatacgtttaacttatgcatgaatcggctattttttcaagctttttcataatagtaattagaattttcgtccgacctttttttttttttttcaccttgttcctacactcaattgcatagtaaaaggtaaacaaattctttagataattattgtttggcataaatgaacgtgagctcaaggctcgaagaaattagaaaattcaataaatgagacagaaagtgaagttgataacaaaaaaaatattgatatcgaacagtataatgccaccttattacacaacatatacacctttatatgttccgtacaatgttcttattttcttaatagtggcttgtcattgtcaatgggctcagttcaacagtaggcccactgactaaaaacaccatttaagtgtaatcagatgcttgcatcggtgatttaagctacgtaatgattaattttacaataattttcctgaacaggttattcagctcaaagaacaactctatgatgcagagagggaaatccaaagattagcagaaagagtagaaggaggctcaagcaacagtccaatttcgtcttccgtttccgtcgaagctaatgaaacgccattttttggagactataaagtcggagatgatggcgatgactatgatcacttgttttatccggtgccggaaaatagttacatcgatgaagcggaatggatgagtctatacatataa

SEQ ID NO: 583 - DNA, 1666 bp, Arabidopsis thaliana; identical to SEQ ID NO: 582
  G412 DNA sequence used for BLAST

SEQ ID NO: 584 - DNA, 1530 bp, Arabidopsis thaliana
  G414 cDNA Sequence
atggaaaactcagacactgattcagaagttttcttttggtttcagaaccaaaaccaaaaccatagccataagtttccttcttcttgttttcctccgagctctcactctgctttttatggatctagctcaatgatcaacacagagactgcaactatggacgaagaagacgtatgtgagagctacatgatgcgtgagataaccaagaaacggaagctaacaccgatccaattgcgtttactagaggagagtttcgaagaagagaaaagactcgaaccagacaggaaactctggctagccgagaagctagggctgcagccaagccaagtcgctgtctggttccaaaacagaagagctagatacaagaccaaacagctcgaacacgactgtgactctcttaaagctagctatgctaagctcaagactgactgggacattctctttgtacaaaaccaaaccctcaagagcaaggtacagtttcttaatagattaacaagccactattttcaagagtctgttcaaaattttgatgacacattcaaacaggtcgatcttctcaaagagaagctgaaaatgcaagagaatcttgaaactcagtctattgagaggaaaagacttggggaagaaggtagttcggtgaaaagcgataacacgcagtacagtgaagaagaaggtttggagaatcaatacagtttcccggagcttgcagttctcggattttattatgatccaaccttaactgcttcaaatctaagacaagaacctttgaaagtcacgtgtgcggatcagatgactcagatccaaatatctgacgtcacagaacctgcgagctccgcacatgtaaactcctgccggagttcatctaacgacacgcggcaatataaaaaaattgaagtgacacagcgaagttcgagtatgagccgcaagagagataaaccctacacaaaccgtcacacaccggcgcgaatttcgaaacgccggcgaccatgggcgccttcgtcatcggagcacgatgagattatcgacaaaccgatcaccaaacctccgccgccaccggcgttggtagttatgggacttcccgccaactgttcagttctggagctaaaatctcgattcgagatctacggttcaatctcccgaatccgaatccataaagacggaattggctccgtttcgtatcgaaccgccgagtcagcagaagccgccattgctggtagtcacgagccttctttcggtatctccatcgattccaaaaagttggaggtggtttgggcgacggatccattggtgaagtggaaggaaggtgtgacggcgggagaaggaaaggagagaacgtcgtcgttttcgtcgaagcttttacgacctgtgatgcctttgagaaaacatgggagaagcagtaggttagcgtcagctattgttaatccgagaagtgataatactaaaggaattagtggagatggagggatatcatctccggcgacgacaagtgaagttaaacagagaaatatagtaacctacgacgatatcgtttaa

SEQ ID NO: 585 - protein, 509 aa, Arabidopsis thaliana
  G414 Amino Acid Sequence
MENSDTDSEVFFWFQNQNQNHSHKFPSSCFPPSSHSAFYGSSSMINTETATMDEEDVCESYMMREITKKRKLTPIQLRLLEESFEEEKRLEPDRKLWLAEKLGLQPSQVAVWFQNRRARYKTKQLEHDCDSLKASYAKLKTDWDILFVQNQTLKSKVQFLNRLTSHYFQESVQNFDDTFKQVDLLKEKLKMQENLETQSIERKRLGEEGSSVKSDNTQYSEEEGLENQYSFPELAVLGFYYDPTLTASNLRQEPLKVTCADQMTQIQISDVTEPASSAHVNSCRSSSNDTRQYKKIEVTQRSSSMSRKRDKPYTNRHTPARISKRRRPWAPSSSEHDEIIDKPITKPPPPPALVVMGLPANCSVLELKSRFEIYGSISRIRIHKDGIGSVSYRTAESAEAAIAGSHEPSFGISIDSKKLEVVWATDPLVKWKEGVTAGEGKERTSSFSSKLLRPVMPLRKHGRSSRLASAIVNPRSDNTKGISGDGGISSPATTSEVKQRNIVTYDDIV

SEQ ID NO: 586 - DNA, 2516 bp, Arabidopsis thaliana
  G414 DNA sequence used for BLAST
atggaaaactcagacactgattcagaagttttcttttggtttcagaaccaaaaccaaaaccatagccataagtttccttcttcttgttttcctccgagctctcactctgctttttatggtatatctctgttcctccattctaattttattttattttattttcttgaaatgcatctttttcacctttgacgaatcttcatccccaaaatgtaaccactcagattaaaagattgtcctttcattttaaaagagtttgaaaagaatagcaagaactttgaagaacctcatgtgacgacataggtcagattctcttctataaaatttgtgtcattcctcattctcttcttaattcaggatctagctcaatgatcaacacagagactgcaactatggacgaagaagacgtatgtgagagctacatgatgcgtgagataaccaagaaacggaagctaacaccgatccaattgcgtttactagaggagagtttcgaagaagagaaaagactcgaaccagacaggaaactctggctagccgagaagctagggctgcagccaagccaagtcgctgtctggttccaaaacagaagagctagatacaagaccaaacagctcgaacacgactgtgactctcttaaagctagctatgctaagctcaagactgactgggacattctctttgtacaaaaccaaaccctcaagagcaaggtacagtttcttaatagattaacaagccactattttcaagagtctgttcaaaattttgatgacacattcaaacaggtcgatcttctcaaagagaagctgaaaatgcaagagaatcttgaaactcagtctattgagaggaaaagacttggggaagaaggtagttcggtgaaaagcgataacacgcagtacagtgaagaagaaggtttggagaatcaatacagtttcccggagcttgcagttctcggattttattatgatccaaccttaactgcttcaaatctaaggttgtgatagtgtaggtcaacaacgttccgtgtgcctcaagttatcttcgctgtctccatcctttttatcttagacttcatattctaagaaagaaagcagtaataatattcattgatggaataaaaatgcattgtaatttaagtcgttaagttatatgaactttttatgaaaatggaaaaggtcacaaggccatattttcagtgactagataaatgaaaagtgcatgcttttcaaatgatatggacgttttggtatttacctcaataattcgtatgctacattttcatataaaccaagagaacctcgagattagaaagtgaacacattccaattagtcaataattcagcaaatagtagaagaaagtagaattgattcatttgagaaaaggactggcactatttgatatatacagtatgctgataatatatattaccattatgcaataatataaaccttatcacaacaaatctttatccgaaccaccaccaatggaagatgttcaaaactcagacaagaacctttgaaagtcacgtgtgcggatcagatgactcagatccaaatatctgacgtcacagaacctgcgagctccgcacatgtaaactcctgccggagttcatctaacgacacgcggcaatatgtgtgtgggttaacaaatgtggattttgtggggtccgctacctatctgttatacactcggatggacagtccagttactatgtgggccttgaggctatgttaatccggcccatttagcttaaccccaatttaatttctatattttcaaaggtagaaaaaaattgaagtgacacagcgaagttcgagtatgagccgcaagagagataaaccctacacaaaccgtcacacaccggcgcgaatttcgaaacgccggcgaccatgggcgccttcgtcatcggagcacgatgagattatcgacaaaccgatcaccaaacctccgccgccaccggcgttggtagttatgggacttcccgccaactgttcagttctggagctaaaatctcgattcgagatctacggttcaatctcccgaatccgaatccataaagacggaattggctccgtttcgtatcgaaccgccgagtcagcagaagccgccattgctggtagtcacgagccttctttcggtatctccatcgattccaaaaaggtaactcgatcgcttcatcgatttgatctaattaccagtttaaaatttgggaactagggtttgattgggtaattgtttgttgcagttggaggtggtttgggcgacggatccattggtgaagtggaaggaaggtgtgacggcgggagaaggaaaggagagaacgtcgtcgttttcgtcgaagcttttacgacctgtgatgcctttgagaaaacatgggagaagcagtaggttagcgtcagctattgttaatccgagaagtgataatactaaaggaattagtggagatggagggatatcatctccggcgacgacaagtgaagttaaacagagaaatatagtaacctacgacgatatcgtttaa

SEQ ID NO: 587 - DNA, 2545 bp, Arabidopsis thaliana; identical to SEQ ID NO: 9
  G418 cDNA Sequence

SEQ ID NO: 588 - protein, 739 aa, Arabidopsis thaliana
  G418 Amino Acid Sequence
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQQRAFHQMGMMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHRLRSNINAYENDASSLLLPSSYSNAAAPAAVSDDLNSRYGGSDAFSAVATCQQSVGGFDDADMDGVNVIRFGTNPTGDVSLTLGLRHAGNMPDKDASFCVREFGGF

SEQ ID NO: 589 - DNA, 3800 bp, Arabidopsis thaliana
  G418 DNA sequence used for BLAST
ttaatgttggatcttagacggatggcctgtcgctactgctgcgtctgcgtctgatgcgtctggtgcggttgtcgttggagtttgtgaagtggtccgaacggcagtgaagttgctttcattgttgttggattttgtgctcttgtcgtcgttgctgttttttgtttcttgatcttcttcgttctcttctaattcctcttctctttctctttcttttgattcttgttggtacatttcttccaccattggtttccataaacgaaccctagcatttatgaaccaatttgatacctgaataaaagagacaaaattttcactagttgaatcattataatatcgaaataaaattgagggctctttttgtttatttgtcatttggttatttaatgtagggatacaagaaattgagggtttctttgggacaattgaaagctgcaaactttgatgtacttgaggaaaaatggacccttttgcgtctttaatgtcgatctctttctctctctcctatgtttttgtatatataaatatgctataataatttaaagacgaatcccaagaaaagctaatggtgagtggaaggcaaaacacatggtgttcctctgtcatatcacaaaccaaacaaagataagaaacaaaaaccatgcaatagagtcatctcaggctactagttagtgtactcgtacatggtgtcaaataattttggcttagtcaaattcgttttgagtaactactagtatttattatttgatgtttataacaagcatgtatatgtttatgaaaattatgaaatgggtttgggtgataaattaatattgtagttatatatataactgtgtactattgtggagtttatttataaacatagaatgatgggtttaaaacaaatctttaaaacacgcggttaagaattcgtaatccagactgtggtcatttgattgtctgattaagagtatactcagctaacacaacttggtgaagtagaggcatatgtatttgattcatggagattttaaatttcattatatcgttggctatatgtatatatgtagactgacctgatttctggataaaccagtctgtcgagccaataggtgtttatctgcatcacttggatacctgagaaagagaccagaaaatgacatcactctctatctttgccctaataaactcaatgtaatttattttctttatcttttcactatatacaatacaatcaagtagacgcaagaaaaagtacagactttttcctaacaagggcgtgagaatctaacagacaaaagaaaagttgatgattacatatcatcgatccagtttttttttttttacttggcttttttggtttggttttactcttaaagcaatttgtcagagaggtgaaaatagtacaaaaacactactcttttgctttatttccattttttcgttcactctcgttaacaataaaatagcaaaattctagagacatagtactaaagaaagtagaggtgaaataacgagaaaataaatactttttctcagcttttttcaaaattcagtttctctataataattaataaataacgagaaagaaagaaaaaattgacttacgggtgaaggaaatgttcgaagagccaagctctaagtatattgacggagcgttcaggcaaaccgcgttgtggccgccaagcttcttgttccatacccatttgatgaaacgcacggttctgacgcaaactttgctctagcaaacgcaaacgcggagtttcaccttttgttaacccggaagaagagattcccgctgcatctttgtccccaagaagttcgcaactctgcttaagctgagccgcaactgcatctttaaggcatctaaaatgtcttgacatagctttttgagccaatgcggtgtacggtaatgccgcaccgtggcccattactatgtcgaaagagttcacaaccatctgcatttgctcgcagtaatggttgtaccgtcggtccacctgccaacgaaacaaaactatacattatacaatccataaatatcaatatttgcctttttcttttaattaatgttattgttaactcgtgtgtgttgtgttatatgttcacgtgattattatttagtgtagattttatcacgggaacctatgcttgtgtacgagcatcatctaataaataaactaatgagattaattagttacctttaaacgagacaaaataagaaaataagatattatatagacaaattattgaccagagaatatacttcaatgtttgcgcaatcctaccaacagcacattttatcgtatcctcgagcataaactaaaatatttatttctagtgagaaaaaagcaaggtcaactaaaaagtagataattcaattatgggtaaacaaataagtaacgtcaagggttagctttaggacgtaactggagagtagcttatatggagaaggaaacgccaattacataattaatcgtaattatttaatgcattttctttgattaatcgattccaccaaacgctaagcatcaaaatattcaatatactttctaatacgaccgtcacacgagcaaaatgattaaattaattttaattttaaacaaatgatggtaggattgcgcaatcaaactctaccaaaataatcaaaaataagtagttaatcgagaaaacaaaagaccaattcagtcatatcaggtttcttgtttctttgtcataactcttggatcaatttatgaatcttatcgaaatgcaacgaaaacaattttacgtaaaatgtatgaactaatatcactgtagagtatagacaaagtcaaaatcaatattaaaagttaatatgaacatacctcttcaagcatggtgagtagtttcactttccttctttgatgctcaatccgatcagacgccgataaaggaggatgctccttgtttgctccggccgacgaaggagagctgccaccaccatcaccaccgcaagtattagggtttgagctgttcccaagtttgttcttcttcaaaaatcctcttccaacactacaaaactcttccaacaactcttgcgcggccgttgtgtacctcgagtttcttaagatattgaccgctgccatggaagaggaagaagcagccggagatgatcggaattggtttaatacttgatggtgatgttgagaagaattagcaagaagagtcttgaattgattgtattgatgatgaggtgatgcgttagaagaattggctccgtagtaaatgtttctatactcttccgcttttgctgcagcctctaaagacgatgagagagataaggacaagccttgtcctccgtgtcctccgctgttttccacgtggacggtcccaatctccgtttggctgttgtgatgatgatgatgatgatcgggagaagactgccacgtcgatatctgctggtgatgctgatgtggaagctgatgcatagacatatgattagtgtagttctgatggtgagttgtgttggtggatggacttggaagtaacatgtgaagagttgaagaattgtggtggctccttggggaagttgtggatgacggagacggtggttgttgcggtggcggtggattcatcaagaataactgcatggcggctgcggtggcggtggctgaatccgtagcattcatagccggaatattctgatgttgctcctcaagcaactgcctatttgaccggaaagattggccgaggtcgagatctcttcctccaccgctgcttccggggaaattaaacatttcggataacataccggctgattcgtagaccggaatcctacctccggcgactgaagattcctcgtccat

SEQ ID NO: 590 - DNA, 2405 bp, Arabidopsis thaliana; identical to SEQ ID NO: 23
  G419 cDNA Sequence

SEQ ID NO: 591 - protein, 610 aa, Arabidopsis thaliana
  G419 Amino Acid Sequence
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 592 - DNA, 3344 bp, Arabidopsis thaliana
  G419 DNA sequence used for BLAST
atggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagaggtatatatattttcaagaaattatttcattactactatcaaaacttacatgagtttcttagaaaatctaatccttttttatttggtttcaacttattcctaaaaatgtaaaatacccacaagtcttttacaaatctttttttttttcctttcatttggtttcaacttattcctaaatatgtaagatacccataaatcttgtattttttcgattcttgattaggtccatatatttcttaaagttacaaatttcttttagatattaagataaaaagattcttttttgtcttcattctttcatgtattctcgtcgaaaacaagttcgatcgtatcaactacgaaaagatcaacccttttaattcctttactcattatttctttttttctatagaaccaaaatataattttgttttctttgctttgagctaatttggagactctagtggtcctccatatttatagcaatcagtttcatcatcataagccataacgagttgtttctttttcgtgtatttactcattctaagaatctacatttacacgattgtgattgaaatctttgtgaatggtgtggggtaacgtttttttgcggttttttggcagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccgtaagttatttcatatacatcctcttaatatatttacacatacctaaaagttactaattgtgtctttctgaagtgatcaatgaaggtagaatcacaagttaattgggtatatttatggagctatataaaacctctttaacgattttatttcattgatagtacgttgataaatagtatgataggttttttttgtttgttacatgaatatttttgaacatataaaagtaaaaaaatatgtacattttatatagagagattgagattgacttgacaagcataggatacaatctaccttaatctgttaattgcatatagcttttttattttcctttttctttcatttgcactattggtgtgaaagtgagtgtacaaacatatacatatacacatgtatatatatgtatacgaacatataaaattaaataaaataaatttaactggtggatgaaagacagaaatagagaaaggtacaaagtggattgagagagagaatcaatgttctttacctaacactaacaaaagagagaaactatacataactccttgcttttttctccatgtttttattttgttctttttcttctactttttatttatttaatttacagaagttatatgtttatcatcatatgtaacacttgtctccatcaattcccaaacactgctcaaacaatgaaacatcttgttagttttcaccaaaccctttacctttgcttccattttatttgcatcattcttcaatcatttatatccttttttttaattacatatccatttgtcttatatttttccattaaagtaaaattttcttatttttgttttcagatatccgagcgatgttgataagcatatattggcccgacaaactggtttatcaagaagtcaggtaaagaataactccactaattcttgatatattccaaaatttattatcctatttactaaagttataataaaccaaaattgttaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtt

SEQ ID NO: 593 - DNA, 1535 bp, Arabidopsis thaliana
  G425 cDNA Sequence
gaaaacagtcttctcttctccgatcccaaaaacgcaggaaaacaatgtcgtttaacagctcccacctccttcctccacaagaagaccttcctctccgacacttcaccgatcaatcacagcaacctccgccgcagcgtcacttctctgaaacaccttcgcttgtcaccgccagtttcctcaacctccctaccacccttaccactgcggattccgatctcgctcctccgcaccgcaacggagacaattccgttgctgatacaaacccacgctggctctcctttcattcggagatgcaaaatactggagaagtacgttctgaagttatcgacggagtcaacgccgatggtgaaacgatactcggcgttgtaggaggtgaagattggcggagtgctagctataaggcggcgattttaagacatccgatgtacgagcagcttcttgcggctcacgtggcttgccttagggttgcgactcccgttgaccagattccgaggatcgatgctcagctcagtcagttgcataccgtcgccgcgaaatactccactcttggtgtggttgttgacaacaaggaacttgatcatttcatgtcacattatgttgtcttgttatgttcatttaaagaacaactccaacaccacgtttgtgtccatgcaatggaagccattacggcttgttgggagattgaacaatcactgcaatccctaactggagtttctccaagtgaaagtaatggtaagacaatgtcggatgatgaagatgataatcaagtagagagcgaggtgaacatgtttgatggaagtttggacggttcagattgcttgatggggtttggtcctcttgttccaaccgagagagagagatctttgatggaacgtgtgaagaaagaactgaagcatgagcttaaacagggtttcaaagagaagattgtggacataagagaagagataatgaggaagagaagggcgggaaagttgccaggagatacgacttctgtactcaaagaatggtggcgaactcactcgaaatggccatacccaactgaggaagataaggcaaaactggttcaagaaaccggtttgcagttgaaacagatcaacaattggttcatcaaccagaggaaaagaaactggaacagcaactcttccacgtcatctactctcaccaagaacaaacgtaaacggaccgggaagtcgtaggtgacatagcggctaactagaggatggttctttgccatgtgaattcttgggaaccgtatatgaaagaaacgaatccggttctatgctcgtacagagtgtgttatttgtatagtggataccggttagcctatgaaaccggattctggagtccaaattgttgtttgtaacgacttagtagtttttggaagtgatctgtttcgttggtttgcgtcttgtaacgaacgcttaagcaagtgtgggttttttcttgtaaagtgtcaatatgttcgtttgtaatgaatgtatcaagcaatatttatcataattaaactagcttgaaatgtaaaaaaaaaaaaaaaa

SEQ ID NO: 594 - protein, 383 aa, Arabidopsis thaliana
  G425 Amino Acid Sequence
MSFNSSHLLPPQEDLPLRHFTDQSQQPPPQRHFSETPSLVTASFLNLPTTLTTADSDLAPPHRNGDNSVADTNPRWLSFHSEMQNTGEVRSEVIDGVNADGETILGVVGGEDWRSASYKAAILRHPMYEQLLAAHVACLRVATPVDQIPRIDAQLSQLHTVAAKYSTLGVVVDNKELDHFMSHYVVLLCSFKEQLQHHVCVHAMEAITACWEIEQSLQSLTGVSPSESNGKTMSDDEDDNQVESEVNMFDGSLDGSDCLMGFGPLVPTERERSLMERVKKELKHELKQGFKEKIVDIREEIMRKRRAGKLPGDTTSVLKEWWRTHSKWPYPTEEDKAKLVQETGLQLKQINNWFINQRKRNWNSNSSTSSTLTKNKRKRTGKS

SEQ ID NO: 595 - DNA, 1883 bp, Arabidopsis thaliana
  G425 DNA sequence used for BLAST
ctacgacttcccggtcctgagtttggttacaaaagaagatcttgaccgggttggtttaatgaaattgcgcaatttgaaaaagagaacggatcttgttttaccgtttacgtttgttcttggtgagagtagatgacgtggaagagttgctgttccagtttcttttcctctggttgatgaaccaattgttgatctgtttcaactgcaaaccggtttcttgaaccagttttgccttatcttcctcctgcaattccaaaaccaaatcacgaattaaaaccttgcttttgacaatgtggtaacaaaacttctcggccaaggtgtttacagttgggtatggccatttcgagtgagttcgccaccattctttgagtacagaagtcgtatctcctggcaactttcccgcccttctcttcctcattatctcttctcttatgtccacaatcttctctttgaaaccctacaggggaaaaaagaaaccgagcaacatgatttaacaatgtgttttgtatagtttgatgtaccattgcagcttgatcaagcaattacctgtttaagctcatgcttcagttctttcttcacacgttccatcaaagatctctctctctcggttggaacaagaggaccaaaccccatcaagcaatctgaaccgtccaaacttccatcaaacatgttcacctcgctctctacttgattatcatcttcatcatccgacattgtcttaccattactttcacttggagaaactcctacaaaccagaacaaagaaaaaccgataaaaccaagacacacataaagcaagaagacaataacaaaaaaaaaaaatgatttgggacgttaccagttagggattgcagtgattgttcaatctcccaacaagccgtaatggcttccattgcatggacacaaacgtggtgttggagttgttctttaaatgaacataacaagacaacataatgtgactgcatcaacataataatcaaaggtaagattccaatccataagacatacaaacagaacgttacaaaaaatagattatgctttctttctcttggacatgcaaagtccttttcagcaagaatcagacaaactattagtcatcaaagaagaagctttatgcaacaaatataacttatttgagtcagacaaagttcataattcgaattacaagctaaccaaaaaagtagaagcaaagatcatatcgattgcaagactcgagaagcgggaacaatgagccacacaaaaatgtgaatttgctatactcagataatcaaagagaaataaatggctgaatcgttcacagttcaaaacattaaaattttgcaaaattagaaagtgaaacttaccatgaaatgatcaagttccttgttgtcaacaaccacaccaagagtggagtatttcgcggcgacggtatgcaactgactgagctgagcatcgatcctcggaatctggtcaacgggagtcgcaaccctaaggcaagccacgtgagccgcaagaagctgctcgtacatcggatgtcttaaaatcgccgccttatagctagcactccgccaatcttcacctcctacaacgccgagtatcgtttcaccatcggcgttgactccgtcgataacttcagaacgtacttctccagtattttgcatctccgaatgaaaggagagccagcgtgggtttgtatcagcaacggaattgtctccgttgcggtgcggaggagcgagatcggaatccgcagtggtaagggtggtagggaggttgaggaaactggcggtgacaagcgaaggtgtttcagagaagtgacgctgcggcggaggttgctgtgattgatcggtgaagtgtcggagaggaaggtcttcttgtggaggaaggaggtgggagctgttaaacgacat

SEQ ID NO: 596 - DNA, 1751 bp, Arabidopsis thaliana
  G426 cDNA Sequence
agagagagaactagtctgtgtcttttttttttttttttggtgataattgaaacatatgaaacaatcgtcgtcatagaagcagcagagattcaccttctttctttatctttccctctcagaaacaggaaacaaaattcaaaaagaacaaaaaaaaaaggtcaaaccaaaaacgatggcgtttcatcacaatcatctctctcaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatgacacattatgtgttgctactgtgttcatttaaagagcaattgcaacaacatgtgcgtgttcatgcaatggaagctgtgatggcttgttgggagattgagcagtctcttcaaagcttaacaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacagggttacaaggagaagatagtagacataagagaggagatattaaggaagagaagagctgggaagttaccaggagataccacctctgttctcaaagcttggtggcaatctcattccaaatggccttaccctactgaggaagataaggcgaggttggtgcaagagacaggtttgcagctaaaacagataaacaattggttcatcaatcagagaaagaggaactggcatagcaatccatcttcttccactgtattgaagaacaaacgcaaaagcaatgcaggtgacaatagcggaagagagcggttcgcgtagaaacaacaaacatatgatgtgaattggggaggtggaagatgggatttgaaagcagggttttagggatttaaagttgagaattttatggaggagtttgggttatacagagagaggggacagtattagaaagtaactttttgtgcaattacatagtaacgtagtttggttatgtgattatgcccatatattttattaagtagcacacaaaccaaaaagaaaatatgaaaactgaagatgcaggcttttgtttaatgttttttgtttgtttgtctgcaaaaaaaaa

SEQ ID NO: 597 - protein, 431 aa, Arabidopsis thaliana
  G426 Amino Acid Sequence
MAFHHNHLSQDLSFNHFTDQHQPPPPQPPPPPPQQQQHFQEAPPPNWLNTALLRSSDNNNNFLNLHTATANTTTASSSDSPSSAAAAAAANQWLSRSSSFLQRNNNNNASIVGDGIDDVTGGADTMIQGEMKTGGGENKNDGGGATAADGVVSWQNARHKAEILSHPLYEQLLSAHVACLRIATPVDQLPRIDAQLAQSQHVVAKYSALGAAAQGLVGDDKELDQFMTHYVLLLCSFKEQLQQHVRVHAMEAVMACWEIEQSLQSLTGVSPGEGMGATMSDDEDEQVESDANMFDGGLDVLGFGPLIPTESERSLMERVRQELKHELKQGYKEKIVDIREEILRKRRAGKLPGDTTSVLKAWWQSHSKWPYPTEEDKARLVQETGLQLKQINNWFINQRKRNWHSNPSSSTVLKNKRKSNAGDNSGRERFA

SEQ ID NO: 598 - DNA, 1908 bp, Arabidopsis thaliana
  G426 Genomic Sequence
atggcgtttcatcacaatcatctctcacaagacctctccttcaatcatttcaccgaccaacaccaacctccacctccgcaaccgcctcctcctcctccgcaacagcaacaacatttccaagaagcaccgcctcctaattggttaaacacagcgcttcttcgttcctcagataacaacaataacttcctcaacctccacacagccaccgctaacaccacaaccgcaagcagctccgattctccttcctccgccgccgccgccgccgctgctaaccagtggctatctcgctcctcctctttcctccaacgaaacaacaacaacaacgcttccatagtcggagatgggatcgatgatgtcaccggaggagcagacactatgattcagggagagatgaaaaccggcggtggagaaaacaaaaacgacggcggaggagctacggcggcggatggagtagtgagctggcagaatgcgagacacaaggcggagatcctttcgcatcctctttacgagcagcttttgtcggcgcacgttgcttgtttgagaatcgcgactccggttgatcagcttccgagaatcgatgctcagcttgctcagtctcaacacgtcgtcgctaaatactcagctttaggcgccgccgctcaaggtctcgtcggcgacgataaagaacttgaccagttcatggtatataaatttcagatttttttgttctataattttataattaacgatttcataattatacttagcacaaattttaataatacacaccgacttaggtttcttgatttttgaaatcttaaaatattaaaatcaagatttgtgtttttagggataaacaagactaaaatcccaaaaaaagagcttatgatataataatggtcatgatgatgaagaaaatacaaattttgttctttgtgtttattgtgtgtttgattaatgttttttttatggtgtagacacattatgtgttgctactgtgttcatttaaagagcaattgcaacaacatgtgcgtgttcatgcaatggaagctgtgatggcttgttgggagattgagcagtctcttcaaagcttaacaggtgagaaaatgaatcctgtgattagctcatgaatccaatagttagttttatgacattgacaagttttgtgttttattggtgagattaggagtgtctcctggagaagggatgggagcaacaatgtctgacgatgaagatgaacaagtagagagtgatgctaatatgttcgatgggggattagatgtgttgggttttggtcctttgattcctactgagagtgagaggtcgttgatggaaagagttagacaagaacttaaacatgaactcaaacaggtaataatcaacaaacttgttctttgaactagttcatgaactaacaatgtagagggctttgtcttgttgatgaaaagggttacaaggagaagatagtagacataagagaggagatattaaggaagagaagagctgggaagttaccaggagataccacctctgttctcaaagcttggtggcaatctcattccaaatggccttaccctactgtgagttcactcatctaacatctctttataacttcttcaagttcattcattgagccataaccaaatattggtttgtaggaggaagataaggcgaggttggtgcaagagacaggtttgcagctaaaacagataaacaattggttcatcaatcagagaaagaggaactggcatagcaatccatcttcttccactgtattgaagaacaaacgcaaaaggtattattatactttaatatagtcttgtaacataaccgaaaaacttatggatcggactcaaagaagactgaaacttttgtttgtctgatgaaagcaatgcaggtgacaatagcggaagagagcggttcgcgtag

SEQ ID NO: 599 - DNA, 1908 bp, Arabidopsis thaliana; identical to SEQ ID NO: 598
  G426 DNA sequence used for BLAST

SEQ ID NO: 600 - DNA, 1379 bp, Arabidopsis thaliana; identical to SEQ ID NO: 49
  G428 cDNA Sequence

SEQ ID NO: 601 - protein, 311 aa, Arabidopsis thaliana
  G428 Amino Acid Sequence
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 602 - DNA, 7619 bp, Arabidopsis thaliana
  G428 Genomic Sequence
gaatgacaataaactcctacaaagttgaagcaaccgagtggtacaataatatattaacaaaaacctcaatacaaagaattgaaacctaacaacactaaatcacgggaacagtatgaacaatccatgatgaaacattcgagtggtacaatattatcttagcaacataattatatgcacttgatctaataatttagtcgtcactttttgttattattattttttctgcaagacacacattttttttttgcaatcatttctcgacgatagtgatcatatagattatagaaacttgtgaccccccccaaaaaatacagaaaagtttagaaacaatataaatatgtgctgtgaaggccaccggtggggattcaatacgatacgatccaacgaagtgaaatgagagagaaggaaagttctgtcgtttttataaggtttgatactaaaacaaagctttatgtcagttaaatttcacaccaaagtagtccgacggatgtgtcaatcaaacctgtccatcatcaaaaagacctttatgacatttgtttttatttttttttgcggaaaaaacgatatggatcatcggatcgggtctggagtagacccatgcaaaaatatagttttttttcttacaacagggtttatagatggattttggtttatgacaaaaactgcaggttctgttactatataaggtaatgaaacattttgagttgatattatacgcgactaacagattctctatgaaaataacaagaagtgcgataagtggagtggccactataaaaaatagttcctaagagtgtgtttaattagcaaatgactgaaagcaattaaaaaacaaaaattgtttactatgttgtgattgataatgagcacctagctaccatagacgtgttttacagagaaacaaaactaggtgaaaattgaaagagtgaaattgaagttgaaccgatccggttagacaactagaatcgtagtagcctagtaggtgtcggccaccgtaattgaaacaaaaagcttattaattaacaaaattaccatcatttgtttttactgtcaaaattcaaattaccatcgtctaacctgtttttgttaacaagtactaattgttgtcttcattagctaagtcataaattctaaaggttagcgtgctattttgatcatttgtgcgataatattatatatcaaaaataatcgtaaccatgtaatcgtacagttaaaaaaagtgctcttgaatcacgaagaaatctttttataatcactcgaatcgtattccttaacacatatggcaaacccttgaaatctttcttcttttatactagtacgacaaaataaaataaaaattatggtgtctttaagaaaaacttgtaaattatcataataaactatgaaaattcatattcgtgatttttttttttttttgcttttcgtcacaaatcatttttttttttttttggttttttgctgaaatatttacgatcattgccctcagactactatactacgagaccgcctcaacttggccagtctatctatttccattgtctctatctctctctctctttgaagcagtttgttacttcttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgatctcgctgctttcgtgttttgtcttttctttttcttgttgtgtatgattttgtgctttcaaggttaatttgattaagcgtcaggaattttacatgtattcatcgtcgtatttaaagatagttctcttacttttttttttctattccactttaaccctaagataagattggagaactagagagactgtgtttatatgtgagagtgatttttttttttttggtaattgattgacaggtgggagcgcctatggaaatagcgtgtatattggaagagattcagcgagagaaccatgtgtacaagagagatgttgctccattatcttgctttggagctgatcctgagcttgatgaattcatggtttctcactttgttcgttgccttgaactttgatcttctagtttttcttaaaatataattttgtttttttgtggtgtgattctaggaaacctactgtgatatattggttaaatacaaaaccgatcttgcgaggccgttcgacgaggctacaactttcataaacaagattgaaatgcagcttcagaacttgtgcactggtccagcgtctgctacagctctttcaggtcagcactaaagtgatatctatctcttgttcgagtgtacttttgatttcttgtttcctagctagtgtttttattgatctttgagcactatcctcggtttgtgtgtcctttaaaatccttgcgcaaatttctccttacagttacagatcttgcggattagaaaatctatcctcagataacttttcctttctgtgcttcaatgatcagtttcttggaattgatggaaaaattggaaatcttctactgttttttttttccttaaagaaaacgagaatcgataagttgttgtagctgaaactaggaggagcttagtagatccggtttagacaacccaaggcaataaaagtcagaaaaaaacaaggaaactctaaaaccctagttttgttagaaaacaatgattgattcagccacatcttttatatttggtagaagtcattcatgctttagatagatccatgaccttcacacatctttgtgacatttattttctatcattagctatggtttaagctgtggggcggatattaggggaaagccggtgggtaggattttctcacgttagtgatatttattttcctagtgattttggtatggtatactttcttttgttacttttatatatacttgtattattatcttctactctgtcagaagaaaatatgggtctatgaaagcaaaaacttttgcgctagagattctgattttgacgtttcagtgtcgtactggaagttttttaattgcttatttccagtgaaaattcaatcatagagaaaaaacctagtcataacttccactaataaatgccactgatttttcttgagtttgtccttggcttcatgtttagatctctagtagtatcgcttgttttcatcttcattaagagactgatgggtaaaacaaaactttactagttcttgattactccaacttctcttggtgaatgaaccaaagtttatactacttttccatagaaagtgtcagacttaagttttatcatgtcactttagtttttactattagagagataaaaatttattgtgtataatgagtataacataagattgatttgttttcttagtgtatgtgaaaattaatgacactagcccttatttttgaatacattgtatttgcacctaagggtcttacatttgaagtccactgtgttcaaattacatgtacaaaatcattggtgtgattaattttcacgaacctatctgacttagtaaaccaaagaagtgtcttgatcaggtcaaatagttggattttgtgtttctttagctcgaaaaagctaaaccaaatctctgttggatttcagttaatctgagctcatgcgcatgtaagtccataaaaatgcttgatggccaagaggcttgtatattctgcatgtcgtggttaatgtgtctgttattcttgtattcttgttggaattttatgtgaataaataaatgattgaaatgcattaagacacttacacaatgtaagtgaggtttactaatttgccgaggtattaaactaaacttaatggtaccttcttttccaccatttgttttcttaattaagcagaatagaactttgtaagtattttacaagcagcccaaataaggaatagtaggtttcttaaaagaatgtaattttagttgtctttgtgttgtttttgtagcttatattggttaaacctttccaacagggcaaaaattagtttcttgttaatctacactaatctacttagccacgttcatgttgtcagaatacgtgtgtatattttttataagtaaagtatttcactatcttagggattttaaagtaatcattttacttcttcatctccacctgataagaactagctggaaaaaaattggaactacaatatagtggaattcagctttaatagtcttctttttcttatatgttgatatcaaatgctgcttcggttgtactttgttagcattgtttaattccgaaaagttgttaatacttatcagcgtacttaattaattggagtttacatagggaataatcttgtccaaaaggttgaaaaacagatcacttgcagcttgaatttatctttattggacgaatgtttagttttttaatggttttgaagtaccacttacctttttagcgtaatctcatgtatgattttgaaggaatatatattaccttatgaacatcttttccttggtcaatacctttttctgtttcttaagtcccgagaaaggactttcttttcaactgaatatcttaaactaatagtataactcataatatgtagttttcagagtcatgtgcttttggtttcttttcgtgctaatatgctttaggaataaaccaaatcctctttagtcaactgatgtttgtcatagcaattgtgtttacttatttttttcgttctcgctttagtgtgcaattgacccttttcgtgattaagatggtcaatcttggccatggtttttgttccatcctcatattttcatctaatcatttggtgttcggatggtgtattgatacaatgagatccatgtgcgattttgtatccatatgtggaatttaggactattgtttaagattattcactacagcctacaactagtatttttgtgttgtaaaatgcattcaccctaggtccctatgcattcaccctagatatatctttggctgtgaatgatattctattcattcaatgttcgtaggaaactcgaaaagcatgttcttttgaacaaaatactctgtcatggcacattagttacttcaccagttctagacatgataatactgataatctgtttggttatatcaccttcgttgatagaatggtccttttgacacgcacaaaataacacacccaaatgcttgaattagaaatcttttagccctttttaatttctaaatagaagaagttggagacagaagcatgaggtggtcaagtgtcacatggactcccgtggattacgttggtggatccctttatgacccaatcgcaacactctctttttaagatttgatttgattttaaagaaaaagaaagagaagaaaataggggagagacatgggttttgatttatgtacaatgcaatcatcttacgactaatgtttctccacatctttttctactgttgcttagtggttgtcatttcctctctgcgtttgttcccttaatgggccatgcaatttccacgtgtttaactttttttgggagatgtacaagtctatctactttttttttatcagtgcatgttgtctctttcgcattgtcttgatgttatataggaaccaaattcggctaataggtaaagacaaaccgagttactattgcacataccatcctcaactagcaaagttttcatggatagggtgtgaactatattttgtgtgatttgtctaaggatcagctcattagtggtgtagcaaactacaacctaaactctttagggagactttgaaacgatgtctttctgtaatcactaagttgagaatactaagtgaaatttctattaatgcaaataatttgaccattaatcatgtttaaactcccttaattaggctcccttttagtcgcagtaacataggggtcagtatggtatggtcataaatggggcattatgagaaagttcataaatgttggggaagcgttttttccgggggtcactcaaacaagtgtcagaaaggtgatacgtgtcgtgactcaggtggctagtggtaagtcccaaaggagcacgtcagtggcaatggaagctaaactattcagtgactgcgaaagtttttgactgatcatttttgtgcccgggtcttgtaaaacctcgatattatctcgctaaaccttggttttccccttttacccctttctttcacccttttttttttttttttttcctttctttcacccttgttctcttctctatgcttttttggctcttttcttcttttagctgctttagccacttagtcatttagccgagcctactagtatcttagtgttagctatgtttgttagtgttggcatagtggtagaatttgctttctacattgtcaaatatgctaccataaatagcaccaccatacattctcctagtacattttatcggtatggcacgtatttggctaatacgtgggagctaatcattattgaatcttctgtatgacattattctcatgtatgagcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgtaagtgtctttctgattccaccgtaacctagcatacactcattaatttatttcttcgacatattaatatccgcctctcgaatgtgtataggaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaatatctgtcttgtctttgtcagttctcaagatcgtacaataaggatgtgggaagttactggggatggtgctctatgtttccggtggtaaagataaatgtttgaagctt

SEQ ID NO: 603 - DNA, 5511 bp, Arabidopsis thaliana
  G428 DNA sequence used for BLAST
atggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgatctcgctgctttcgtgttttgtcttttctttttcttgttgtgtatgattttgtgctttcaaggttaatttgattaagcgtcaggaattttacatgtattcatcgtcgtatttaaagatagttctcttacttttttttttctattccactttaaccctaagataagattggagaactagagagactgtgtttatatgtgagagtgatttttttttttttttggttattgattgacaggtgggagcgcctatggaaatagcgtgtatattggaagagattcagcgagagaaccatgtgtacaagagagatgttgctccattatcttgctttggagctgatcctgagcttgatgaattcatggtttctcactttgttcgttgccttgaactttgatcttctagtttttcttaaaatataattttgtttttttgtggtgtgattctaggaaacctactgtgatatattggttaaatacaaaaccgatcttgcgaggccgttcgacgaggctacaactttcataaacaagattgaaatgcagcttcagaacttgtgcactggtccagcgtctgctacagctctttcaggtcagcactaaagtgatatctatctcttgttcgagtgtacttttgatttcttgtttcctagctagtgtttttattgatctttgagcactatcctcggtttgtgtgtcctttaaaatccttgcgcaaatttctccttacagttacagatcttgcggattagaaaatctatcctcagataacttttcctttctgtgcttcaatgatcagtttcttggaattgatggaaaaattggaaatcttctactgttttttttttccttaaagaaaacgagaatcgataagttgttgtagctgaaactaggaggagcttagtagatccggtttagacaacccaaggcaataaaagtcagaaaaaaacaaggaaactctaaaaccctagttttgttagaaaacaatgattgattcagccacatcttttatatttggtagaagtcattcatgctttagatagatccatgaccttcacacatctttgtgacatttattttctatcattagctatggtttaagctgtggggcggatattaggggaaagccggtgggtaggattttctctgttagtgatatttattttcctagtgattttggtatggtatacttttcttttgttacttttatatatacttgtattattatcttctcctctgtcagaagaaaatatgggtctatgaaagcaaaaacttttgcgctagagattctgattttgacgtttcagtgtcgtactggaagttttttaattgcttatttccagtgaaaattcaatcatagagaaaaaacctagtcataacttccactaataaatgccactgatttttcttgagtttgtccttggcttcatgtttagatctctagtagtatcgcttgttttcatcttcattaagagactgatgggtaaaacaaaactttactagttcttgattactccaacttctcttggtgaatgaaccaaagtttatactacttttccatagaaagtgtcagacttaagttttatccatgtcactttagtttttactattagagagataaaaatttattgtgtataatgagtataacataagattgatttgttttcttagtgtatgtgaaaattaatgacactagcccttatttttgaatacattgtatttgcacctaagggtcttacatttgaagtccactgtgttcaaattacatgtacaaaatcattggtgtgattaattttcacgaacctatctgacttagtaaaccaaagaagtgtcttgatcaggtcaaatagttggattttgtgtttctttagctcgaaaaagctaaaccaaatctctgttggatttcagttaatctgagctcatgcgcatgtaagtccataaaaatgcttgatggccaagaggcttgtatattctgcatgtcgtggttaatgtgtctgttattcttgtattcttgttggaattttatgtgaataaataaatgattgaaatgcattaagacacttacacaatgtaagtgaggtttactaatttgccgaggtattaaactaaacttaatggtaccttcttttccaccatttgttttcttaattaagcagaatagaactttgtaagtattttacaagcagcccaaataaggaatagtaggtttcttaaaagaatgtaattttagttgtctttgtgttgtttttgtagcttatattggttaaacctttccaacagggcaaaaattagtttcttgttaatctacactaatctacttagccacgttcatgttgtcagaatacgtgtgtatattttttataagtaaagtatttcactatcttagggattttaaagtaatcattttacttcttcatctccacctgataagaactagctggaaaaaaattggaactacaatatagtggaattcagctttaatagtcttctttttcttatatgttgatatcaaatgctgcttcggttgtactttgttagcattgtttaattccgaaaagttgttaatacttatcagcgtacttaattaattggagtttacatagggaataatcttgtccaaaaggttgaaaaacagatcacttgcagcttgaatttatctttattggacgaatgtttagttttttaatggttttgaagtaccacttacctttttagcgtaatctcatgtatgattttgaaggaatatatattaccttatgaacatcttttccttggtcaatacctttttctgtttcttaagtcccgagaaaggactttcttttcaactgaatatcttaaactaatagtataactcataatatgtagttttcagagtcatgtgcttttggtttcttttcgtgctaatatgctttaggaataaaccaaatcctctttagtcaactgatgtttgtcatagcaattgtgtttacttatttttttcgttctcgctttagtgtgcaattgacccttttcgtgattaagatggtcaatcttggccatggtttttgttccatcctcatattttcttctaatcatttggtgttcggatggtgtattgatacaatgagatccatgtgcgattttgtatccatatgtggaatttaggactattgtttaagattattcactacagtctacaactagtatttttgtgttgtaaaatgcattcaccctaggtccctatgcattcaccctagatatatctttggctgtgaatgatattctattcattcaatgttcgtaggaaactcgaaaagcatgttcttttgaacaaaatactctgtcatggcacattagttacttcaccagttctagacatgataatactgataatctgtttggttatatcaccttcgttgatagaatggtccttttgacacgcacaaaaaaacacacccaaatgcttgaattagaaatcttttagccctttttaatttctaaatagaagaagttggagacagaagcatgaggtggtcaagtgtcacatggactcccgtggattacgttggtggatccctttatgacccaatcgcaacactctctttttaagatttgatttgattttaaagaaaaagaaagagaagaaaataggggagagacatgggttttgatttatgtacaatgcaatcatcttacgactaatgtttctccacatctttttctactgttgcttagtggttgtcatttcctctctgcgtttgttcccttaatgggccatgcaatttccacgtgtttaactttttttgggagatgtacaagtctatctactttttttttatcagtgcatgttgtctctttcgcattgtcttgatgttatataggaaccaaattcggctaataggtaaagaacaaaccgagttactattgcacataccatcctcaactagcaaagttttcatggatagggtgtgaactatattttgtgtgatttgtctaaggatcagctcattagtggtgtagcaaactacaacctaaactctttagggagactttgaaacgatgtctttctgtaatcactaagttgagaatactaagtgaaatttctattaatgcaaataatttgaccattaatcatgtttaaactcccttaattaggctcccttttagtcgcagtaacataggggtcagtatggtatggtcataaatggggcattatgagaaagttcataaatgttggggaagcgttttttccgggggtcactcaaacaagtgtcagaaaggtgatacgtgtcgtgactcaggtggctagtggtaagtcccaaaggagcacgtcagtggcaatggaagctaaactattcagtgactgcgaaagtttttgactgatcatttttgtgcccgggtcttgtaaaacctcgatattatctcgctatccttgtttttccccttttacccctttctttcacccttttttttttttttttttcctttctttcacccttgttctcttctctatgcttttttggctcttttcttcttttagctgctttagccacttagtcatttagccgagcctactagtatcttagtgttagctatgtttgttagtgttggcatagtggtagaatttgctttctacattgtcaaatatgctaccataaatagcaccaccatacattctcctagtacattttatcggtatggcacgtatttggctaatacgtgggagctaatcattattgaatcttctgtatgacattattctcatgtatgagcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgtaagtgtctttctgattccaccgtaacctagcatacactcattaatttatttcttcgacatattaatatccgcctctcgaatgtgtataggaaggcgacaaaatatctctggctgaagaaacaggtttggatcaaaaacaaatcaacaattggtttataaaccaaaggaaacgccattggaagccttcggagaacatgccgtttgatatgatggacgattctaatgaaacattctttaccgagtaa

SEQ ID NO: 604 - DNA, 1149 bp, Arabidopsis thaliana; identical to SEQ ID NO: 55
  G431 cDNA Sequence

SEQ ID NO: 605 - protein, 382 aa, Arabidopsis thaliana
  G431 Amino Acid Sequence
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSFSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLDNPFPMDHISSTML

SEQ ID NO: 606 - DNA, 2927 bp, Arabidopsis thaliana
  G431 Genomic Sequence
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggtgatgagagaaagaaacttgaaaaaattactttgaaagtttcttcgtaactctaatgattcttatttgattttcttgcacaaaaaagaagagaaagattctagaaaccctaattaccaaactttaccttttatttcctttttacataaccctttacttgatgtctgagtttgattttgatatctacttttgtttactagttacttaacccagctaagtatatacaaatcaaaggatacaatttttcctatattgagaaagtttcaagaaacaatttgtaaaaaccctacttgcaagagattatccaaaatattgtatgtaggcttgaagattaggacatatataattatttcatttttttctttactatattatatatccacaataaacgtgaggatccttatcttagttcaattaacgtttttatgtctatcatttactaattacacaatttcttaaggttggagcaccaccggaggttgtggcgaggctagaggaggcatgctcgtctgccgcagccgctgccgcatctatgggaccaacaggatgtctaggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttactctctcctctctctctagttctctgtttttttttctttctttttaattcatattcttgttaattatggcgtcaaattaaacgtaagatgaggaaagttgttttttttctttgtgggttttaagaaagattttcctttttctgatttttcttgggtaaatacccctttgatggttgttactagggttagtgtcagattgttatatatagcttactaggtttacgtgtataatctatctatacataagttagtgtatgtagttgttttcattgaattaaaacagtttgtttactgtttttttgttttgtttggaattgaattcatttgctttggtacaacaacaatcactgttcttgtctctttcttctccgtttgttttggatctatttaattcaaatgcatcaaaaagaatatctggatctagagtctgctcgtccttagatctattgctcaatttagacatacacatgtttttgtacgtataatcacatatacatatatctacacaatgtcatatcactcttcttttcaagaatgtagttaagtttatatagacacacaaactcacatctacttaacatgttactttgaattatttggatcactagcctattctttttcatttccctagacacatgttcttgttgacaaatttgtcttgctttcacatgtttaatcaatataaggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggtaactctcttcccttatactctaattaaataatcatttcatgtttttaaaaaagcatttatatgatagcaaattcaatttagttgtctattagcttgtttcaatgtttttagtgatttttgcattcatactatatcgttagggacattagtttatgttagctcatgttggcattgcacaatatgcatttgcataatttgaaatcctaaaagctgaatgaagtgaacttatttagtctatgtgtactgttttggtctattagccgatgacaaacttgattcttgcttccataccttttttagggtccgaataatatgtcaatcttagtcaagactacgatcaatttcatcttatggctgtgtaccataacttagactaaactttgttgcacatatttcaagtcataactttggaaagtagggtgcatgaggccataccctaatgcaatagtagctcatgtctttattacacttgtatagtgtcattacccatgttcgtatgagtagatggattctaagttctccttacaatctagcaaatcgtgatgtagctgtgatcatggactgaccttatatcggagagaacacttgatgattgattttttctcgcatgtgatatgaaattgcaggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttga

SEQ ID NO: 607 - DNA, 2927 bp, Arabidopsis thaliana
  G431 DNA sequence used for BLAST
tcaaagcatggtggaggagatgtgatccattgggaaaggattgcccaagacattatccatgaagtaatggtgaggatgtgttgcgtccattactacaaactgcatgtcctccgacggcttccaatgccgtttcctctggtttatgaaccaattgtttatctgtttctggtccagccccgttgattccgcaagggcgagcttttgttgctcctgcaatttcatatcacatgcgagaaaaaatcaatcatcaagtgttctctccgatataaggtcagtccatgatcacagctacatcacgatttgctagattgtaaggagaacttagaatccatctactcatacgaacatgggtaatgacactatacaagtgtaataaagacatgagctactattgcattagggtatggcctcatgcaccctactttccaaagttatgacttgaaatatgtgcaacaaagtttagtctaagttatggtacacagccataagatgaaattgatcgtagtcttgactaagattgacatattattcggaccctaaaaaaggtatggaagcaagaatcaagtttgtcatcggctaatagaccaaaacagtacacatagactaaataagttcacttcattcagcttttaggatttcaaattatgcaaatgcatattgtgcaatgccaacatgagctaacataaactaatgtccctaacgatatagtatgaatgcaaaaatcactaaaaacattgaaacaagctaatagacaactaaattgaatttgctatcatataaatgcttttttaaaaacatgaaatgattatttaattagagtataagggaagagagttaccgaagggtaaggccatttgtagtgacggctccaccaatcaagcagttgttgacgagcttctttagggagctttcctttcttcctcttcttcatgaactcttgcttgaggctccctaagtaaccactgtacttgcgcaagagctgtcctttaagctctctatcctcagcttgtggatctacaaattcattgttcatatcgacttcttcctcggatgacccattattgttcctatcaattgctgtctctccataaccttatattgattaaacatgtgaaagcaagacaaatttgtcaacaagaacatgtgtctagggaaatgaaaaagaataggctagtgatccaaataattcaaagtaacatgttaagtagatgtgagtttgtgtgtctatataaacttaactacattcttgaaaagaagagtgatatgacattgtgtagatatatgtatatgtgattatacgtacaaaaacatgtgtatgtctaaattgagcaatagatctaaggacgagcagactctagatccagatattctttttgatgcatttgaattaaatagatccaaaacaaacggagaagaaagagacaagaacagtgattgttgttgtaccaaagcaaatgaattcaattccaaacaaaacaaaaaaacagtaaacaaactgttttaattcaatgaaaacaactacatacactaacttatgtatagatagattatacacgtaaacctagtaagctatatataacaatctgacactaaccctagtaacaaccatcaaaggggtatttacccaagaaaaatcagaaaaaggaaaatctttcttaaaacccacaaagaaaaaaaacaactttcctcatcttacgtttaatttgacgccataattaacaagaatatgaattaaaaagaaagaaaaaaaaacagagaactagagagagaggagagagtaaccggagaaagaggaaggtgaggatagagagagggatttgaattgacactcgacacgttgaaggaagaccatagcttccttgaaaggtttggagagctcttgctcatacttaacgagcatttcacagtaagcttccatgaattgatcaagccctggatcttcacctagacatcctgttggtcccatagatgcggcagcggctgcggcagacgagcatgcctcctctagcctcgccacaacctccggtggtgctccaaccttaagaaattgtgtaattagtaaatgatagacataaaaacgttaattgaactaagataaggatcctcacgtttattgtggatatataatatagtaaagaaaaaaatgaaataattatatatgtcctaatcttcaagcctacatacaatattttggataatctcttgcaagtagggtttttacaaattgtttcttgaaactttctcaatataggaaaaattgtatcctttgatttgtatatacttagctgggttaagtaactagtaaacaaaagtagatatcaaaatcaaactcagacatcaagtaaagggttatgtaaaaaggaaataaaaggtaaagtttggtaattagggtttctagaatctttctcttcttttttgtgcaagaaaatcaaataagaatcattagagttacgaagaaactttcaaagtaattttttcaagtttctttctctcatcaccttctgacaattgacataagcggccaagaggcggtggtagtgaggatgagccatgatcttggccttgacagaggctgaagaagaggaagaggagcaagggttgattcctcctgcaacgatttcgttatgatggatctccattagagaataggcaggagcacaagaggaaggagaagaagaagaagcaactttgttcttagttccttggggaggagctagtgattgaagaaaaagggaactactttgttggtggtgtgactgatatgcataaccatcatgttcttgttgttgatgttgatgatcatgaccatgatgttgatgtgatgtcatgatgggcggcatcatcatcatcataggacacatcggaccatcactattatccccggcaaaagccattggacaagaagtgctgttggaaccactctccat

SEQ ID NO: 608 - DNA, 1197 bp, Arabidopsis thaliana
  G432 cDNA Sequence
atggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaagattggagctccacctgatgtggttgatagaattacggcggcacggcaagactttgaggctcgacaacagcggtcaacaccgtctgtctctgcctcctctagagacccggagttagatcaattcatggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctgatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataa

SEQ ID NO: 609 - protein, 398 aa, Arabidopsis thaliana
  G432 Amino Acid Sequence
MEEYQHDNSTTPQRVSFLYSPISSSNKNDNTSDTNNNNNNNNSSNYGPGYNNTNNNNHHHQHMLFPHMSSLLPQTTENCFRSDHDQPNNNNNPSVKSEASSSRINHYSMLMRAIHNTQEANNNNNDNVSDVEAMKAKIIAHPHYSTLLQAYLDCQKIGAPPDVVDRITAARQDFEARQQRSTPSVSASSRDPELDQFMEAYCDMLVKYREELTRPIQEAMEFIRRIESQLSMLCQSPIHILNNPDGKSDNMGSSDEEQENNSGGETELPEIDPRAEDRELKNHLLKKYSGYLSSLKQELSKKKKKGKLPKEARQKLLTWWELHYKWPYPSESEKVALAESTGLDQKQINNWFINQRKRHWKPSEDMQFMVMDGLQHPHHAALYMDGHYMGDGPYRLGP

SEQ ID NO: 610 - DNA, 2642 bp, Arabidopsis thaliana
  G432 Genomic Sequence
atggaagaataccagcatgacaacagcaccactcctcaaagagtaagtttcttgtactctccaatctcttcttccaacaaaaacgataacacaagtgataccaacaacaacaacaacaataataatagtagcaattatggtcctggttacaataatactaacaacaacaatcatcaccaccaacacatgttgtttccacatatgagctctcttctccctcaaacaaccgagaattgcttccgatctgatcatgatcaacccaacaacaacaacaacccatctgttaaatctgaagctagctcctcaagaatcaatcattactccatgttaatgagagccatccacaatactcaagaagctaacaacaacaacaatgacaacgtaagcgatgttgaagccatgaaggctaaaatcattgctcatcctcactactctaccctcctacaagcttacttggactgccaaaaggtttggttttattcttattgttatgttataatatatactctttttttaaagatataatatatagttatgtgtgacatatatatgtatgttcatgggtcatggtttatatagattggagctccacctgatgtggttgatagaattacggcggcacggcaagactttgaggctcgacaacagcggtcaacaccgtctgtctctgcctcctctagagacccggagttagatcaattcatggttcattactaaccaaagttgaattttaattaaatgggtcggttctttgtgtgtatatgtgttagaagtcttgattttccttttttattttttggtatgaataggaagcatactgtgacatgttggttaaatatcgtgaggagctaacaaggcccattcaggaagcaatggagtttatacgtcgtattgaatctcagcttagcatgttgtgtcagagtcccattcacatcctcaacaatcctggtacatgtcatcaatctcatatacatacatatatgcacatgtaagaaatggctggagaaaacaaagtgtagtggcaaggtagggctaatgatggattgcataaattggcatgtttctttggttcatggtaaattgttgtaacattgagatattaaaaaaaaaaaaaatcatagtctacatacattttcaaatgttaattaagattataagataattaagataattgagatgcattattgttggaaagtatgtaagatacaaataggtgtgcatatttgttcttgttttccccattgtggaatccatccaaagatgggtggggcttatttttgttttttttcttttcactcggcccaaaagtactatcacaagaacttttggtgctgctcgtgaagatttatttgggacattatcttcttcgatttcgttatgctaaaacatcaaaatctctactcggattaattagtctaatcataaaggtagatgactagaatgttgttaaatgactaaaccatttaacttcatgaaatatattatgttgaagcagatgggaagagtgacaatatgggatcatcagacgaagaacaagagaataacagcggaggggaaacagaattaccggaaatagacccgagggccgaagatcgggaactcaagaaccatttgctgaagaagtatagtggatacttaagcagtttgaagcaagaactatccaagaagaaaaagaaaggtaaacttcctaaagaagcacggcagaagcttctcacgtggtgggagttgcattacaagtggccatatccttctgtacgtataaattttctctcatctctctttgccctcatattttttaaaatatatactacaaattaagtgttttaaaaacctatctttaagctagcaattccctctgaagccgctatgttaggccaagtaggtacttgcatgaccgattttgtgtttaaatccttgtacggtttccaacaacatggttttaaatccgaatgctcacaacactagaattagtcactaggatacatatcttagtcatggtgttctaacccttaacatactattttctaacacgtatatcaatcacttttttttaaaaaatgtaagtttgtgatgaaatttttatccatatattttgaaacaatttaattttttttgtagttttaattagtttgaaatgaaataactaatctaaccgactgtaatgatagtgaaaaaaacatgtttaatattggtaaatataaatgacatgttgttaaaaagataataagacaacatatagttagtcgttacttgatgtcaaagaaaaatgaagttagtcattttacttagagaatcgttcaaaacaacaaactttaggtcattttccatttttatgtctagaatcatttaaaaataattttcgattatctctagcattgctttttatacattgattactacataaatgaagatggttggtttgagttgtgtggcaggagtcagagaaggtagcgttggcggaatcaacggggttagatcagaaacaaatcaacaattggttcataaaccaaagaaagcgtcactggaaaccatctgaagacatgcagttcatggtgatggatggtctgcagcacccgcaccacgcagctctgtacatggatggtcattacatgggtgatggaccttatcgtctcggtccataa

SEQ ID NO: 611 - DNA, 2642 bp, Arabidopsis thaliana; identical to SEQ ID NO: 610
  G432 DNA sequence used for BLAST

SEQ ID NO: 612 - DNA, 627 bp, Arabidopsis thaliana
  G435 cDNA Sequence
aacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattccaatatatatagtcttgtctctgttttgtttcgtttgatctgtttctctttgtctgaatagatttaaaatttgtaattaaagtcattcagacattcacta

SEQ ID NO: 613 - protein, 156 aa, Arabidopsis thaliana
  G435 Amino Acid Sequence
MENSQSQGKNKKKRLTQDQVRQLEKCFTMNKKLEPDLKLQLSNQLGLPQRQVAVWFQNKRARFKTQSLEVQHCTLQSKHEAALSDKAKLEHQVQFLQDELKRARNQLALFTNQDSPVDNSNLGSCDEDHDDQVVVFDELYACFVSNGHGSSSTSWV

SEQ ID NO: 614 - DNA, 468 bp, Arabidopsis thaliana
  G435 DNA sequence used for BLAST
atggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtc

SEQ ID NO: 615 - DNA, 2821 bp, Arabidopsis thaliana; identical to SEQ ID NO: 52
  G438 cDNA Sequence

SEQ ID NO: 616 - protein, 842 aa, Arabidopsis thaliana
  G438 Amino Acid Sequence
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 617 - DNA, 4200 bp, Arabidopsis thaliana
  G438 Genomic Sequence
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtattgcttctctttaatatggccaggattaatttttaattaaggattttgaatttgattctattggatttagtgtgttatattcaatggatatgaaggaccacttttgttgttatttcaagatttgatgcttcaattcaattctccgacacaatttcctgtttttacaaaagggttcctttgaatctgtctggtagatttggttattcaatagcttggtgtaactgttcttgtgacgatatggttactgtctgatctggtgtctaatcttaggagttttgttgattcgttttgttgtgtggtttcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgtatgtaacttaacatttccttttgtcaaatgtgttcttaaagaatcatttgttactcctatcagttcaacatgtagcttgagttataaagttactgacttgttgttttaacttcaggttaacgatccaagctgtgaatctgtggtcacaactcctcagcattcgcttagagatgcgaatagtcctgctgggtaaagtttcatttttggttttgaagtaacctttttctaatcttttttctttgcctaattgcttggttttggtcttagattgctctcaatcgcagaggagactttggcagagttcctatccaaggctacaggaactgctgttgattgggttcagatgcctgggatgaaggttatacgcatctcgtatcattacttaagtgttattttatctgttgatatctatggcaatatgtgaaatattgaaatgttgtgtgttgtagcctggtccggattcggttggcatctttgccatttcgcaaagatgcaatggagtggcagctcgagcctgtggtcttgttagcttagaacctatgaaggtaagaaagggacactcttttcgttgctaaagatacaagtcataatgtttcattttcaaccagtttgggttttttgtgttcttacagattgcagagatcctcaaagatcggccatcttggttccgtgactgtaggagccttgaagttttcactatgttcccggctggtaatggtggcacaatcgagcttgtttatatgcaggtgaatcctttagcctcttctggtttagttttctatctctaacacttgaagatgaatgaataaagttgtgacatttgttcagacgtatgcaccaacgactctggctcctgcccgcgatttctggaccctgagatacacaacgagcctcgacaatgggagttttgtggtatgcagctctcataatgtctagtgtttacagaaaaactctgggatcttgatgtttttcatatgtctttaaaaggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggtacttaaatcttcacatgtggcattttgtgtgtgttttcaggaatttctagaagaattgattataaacatttgttcttgcattgtaggcttggagtgttccggatgtgcttcgacccctttatgagtcatccaaagtcgttgcacaaaaaatgaccatttccgtgagtgtatacatataataaccttaagctttgattgattcatataacatatctaacggttggaggtgcttcatgttttaggcgttgcggtatatcaggcaattagcccaagagtctaatggtgaagtagtgtatggattaggaaggcagcctgctgttcttagaacctttagccaaagattaagcaggtacttcgatcttgagctaaaacctaattgttctttgctctgtttgctcattgtcattttttctgttcttggttttcttgaaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaagtaagttagtgtgtccagtattggtactttgtgttcttttgacagttttctatggctgaaatttgtgttatctattgtcttctgtagaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaagtaaggcttcaaagtctttacctgccgacaaaacatcatttttatgtctctctcttacatatatatttggttttgttatgtttagatgctagaagttgttagactggaaggtcattctcttgctcaagaagatgcatttatgtcacgggatgtccatctccttcaggtatatcacttctaagttctaacccaatggatcttgaaatttttaccatttcaaagttaaaattgaccttaatgatttatggtagatttgtaccgggattgacgagaatgccgttggagcttgttctgaactgatatttgctccgattaatgagatgttcccggatgatgctccacttgttccctctggattccgagtcatacccgttgatgctaaaacggtactcttctttgctgtaccactgatttttcttttacttagagatggtttgtttcaaggctcattttttcttactcatacagggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacaggtgggggtgtaaatgtttactctcgtctctttcttataatcctcgaacttatcgatgatgccttatgctgatatgtttgtttttccagtcatcacttaggctcggagttgctgacgattgattcacttggaagcgacgactcggtactaaaacttctatgggatcaccaagatgccatcctgtgttgctcattaaaggtatgtgtcctacaccaaacaaaaagcagaatacacctgtagttttagacgtataatatggtctggatatgttgcagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacaggtaaagaaccaaaacaaaaacatctgcagataaatggttttgattcatttgtctgagaactatctttgcgtctacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtga

SEQ ID NO: 618 - DNA, 4197 bp, Arabidopsis thaliana
  G438 DNA sequence used for BLAST
atggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtattgcttctctttaatatggccaggattaatttttaattaaggattttgaatttgattctattggatttagtgtgttatattcaatggatatgaaggaccacttttgttgttatttcaagatttgatgcttcaattcaattctccgacacaatttcctgtttttacaaaagggttcctttgaatctgtctggtagatttggttattcaatagcttggtgtaactgttcttgtgacgatatggttactgtctgatctggtgtctaatcttaggagttttgttgattcgttttgttgtgtggtttcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgtatgtaacttaacatttccttttgtcaaatgtgttcttaaagaatcatttgttactcctatcagttcaacatgtagcttgagttataaagttactgacttgttgttttaacttcaggttaacgatccaagctgtgaatctgtggtcacaactcctcagcattcgcttagagatgcgaatagtcctgctgggtaaagtttcatttttggttttgaagtaacctttttctaatcttttttctttgcctaattgcttggttttggtcttagattgctctcaatcgcagaggagactttggcagagttcctatccaaggctacaggaactgctgttgattgggttcagatgcctgggatgaaggttatacgcatctcgtatcattacttaagtgttattttatctgttgatatctatggcaatatgtgaaatattgaaatgttgtgtgttgtagcctggtccggattcggttggcatctttgccatttcgcaaagatgcaatggagtggcagctcgagcctgtggtcttgttagcttagaacctatgaaggtaagaaagggacactcttttcgttgctaaagatacaagtcataatgtttcattttcaaccagtttgggttttttgtgttcttacagattgcagagatcctcaaagatcggccatcttggttccgtgactgtaggagccttgaagttttcactatgttcccggctggtaatggtggcacaatcgagcttgtttatatgcaggtgaatcctttagcctcttctggtttagttttctatctctaacacttgaagatgaatgaataaagttgtgacatttgttcagacgtatgcaccaacgactctggctcctgcccgcgatttctggaccctgagatacacaacgagcctcgacaatgggagttttgtggtatgcagctctcataatgtctagtgtttacagaaaaactctgggatcttgatgtttttcatatgtctttaaaaggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggtacttaaatcttcacatgtggcattttgtgtgtgttttcaggaatttctagaagaattgattataaacatttgttcttgcattgtaggcttggagtgttccggatgtgcttcgacccctttatgagtcatccaaagtcgttgcacaaaaaatgaccatttccgtgagtgtatacatataataaccttaagctttgattgattcatataacatatctaacggttggaggtgcttcatgttttaggcgttgcggtatatcaggcaattagcccaagagtctaatggtgaagtagtgtatggattaggaaggcagcctgctgttcttagaacctttagccaaagattaagcaggtacttcgatcttgagctaaaacctaattgttctttgctctgtttgctcattgtcattttttctgttcttggttttcttgaaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaagtaagttagtgtgtccagtattggtactttgtgttcttttgacagttttctatggctgaaatttgtgttatctattgtcttctgtagaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaagtaaggcttcaaagtctttacctgccgacaaaacatcatttttatgtctctctcttacatatatatttggttttgttatgtttagatgctagaagttgttagactggaaggtcattctcttgctcaagaagatgcatttatgtcacgggatgtccatctccttcaggtatatcacttctaagttctaacccaatggatcttgaaatttttaccatttcaaagttaaaattgaccttaatgatttatggtagatttgtaccgggattgacgagaatgccgttggagcttgttctgaactgatatttgctccgattaatgagatgttcccggatgatgctccacttgttccctctggattccgagtcatacccgttgatgctaaaacggtactcttctttgctgtaccactgatttttcttttacttagagatggtttgtttcaaggctcattttttcttactcatacagggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacaggtgggggtgtaaatgtttactctcgtctctttcttataatcctcgaacttatcgatgatgccttatgctgatatgtttgtttttccagtcatcacttaggctcggagttgctgacgattgattcacttggaagcgacgactcggtactaaaacttctatgggatcaccaagatgccatcctgtgttgctcattaaaggtatgtgtcctacaccaaacaaaaagcagaatacacctgtagttttagacgtataatatggtctggatatgttgcagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacaggtaaagaaccaaaacaaaaacatctgcagataaatggttttgattcatttgtctgagaactatctttgcgtctacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtg

SEQ ID NO: 619 - DNA, 1177 bp, Arabidopsis thaliana
  G439 cDNA Sequence
tataaatcttcgtttctacttttttttcttccataatatagtcaattcgttttcttaattagggcttcttctctttgtttctccaatctttattagtttatttatttattttggttattgtatacaaatggcaatggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttctgaatccattttatctttttgattcatttgtctctaaattgtagaattttattttcagagctttgtaagggaagttcttgaatgagagttgcagaggactagtggaacctaactctgttttcttttgtaagtattgtttataatgggccgttgaatgggccttattgatttaaacagcccaagtttttaaaaaaaaaaaaaaaaaaaaaaaaa

SEQ ID NO: 620 - protein, 279 aa, Arabidopsis thaliana
  G439 Amino Acid Sequence
MAMALNMNAYVDEFMEALEPFMKVTSSSSTSNSSNPKPLTPNFIPNNDQVLPVSNQTGPIGLNQLTPTQILQIQTELHLRQNQSRRRAGSHLLTAKPTSMKKIDVATKPVKLYRGVRQRQWGKWVAEIRLPKNRTRLWLGTFETAQEAALAYDQAAHKIRGDNARLNFPDIVRQGHYKQILSPSINAKIESICNSSDLPLPQIEKQNKTEEVLSGFSKPEKEPEFGEIYGCGYSGSSPESDITLLDFSSDCVKEDESFLMGLHKYPSLEIDWDAIEKLF

SEQ ID NO: 621 - DNA, 840 bp, Arabidopsis thaliana
  G439 Genomic Sequence
atggcaatggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttctga

SEQ ID NO: 622 - DNA, 837 bp, Arabidopsis thaliana
  G439 DNA sequence used for BLAST
atggcaatggctttaaacatgaatgcttacgtagacgagttcatggaagctcttgaaccattcatgaaggtaacttcatcttcttctacttcgaattcatcaaatccaaaaccattaactcctaatttcatccctaataatgaccaagtcttaccggtatctaaccaaaccggtccgattgggctaaaccagctcactccaacacaaatcctccaaattcagacagagttacatctccggcaaaaccaatctcgtcgtcgcgctggtagtcatcttctcaccgctaaaccaacctcaatgaagaaaatcgacgtagcaactaaaccggttaaactataccgaggcgtaagacagaggcaatggggtaaatgggtagctgagattcggctacctaaaaaccgaacccggttatggctcggtacgttcgaaacggctcaagaagctgcattagcttacgatcaagcagctcataagatcagaggagacaacgctcgtctcaatttcccagacattgttcgtcaaggacactataaacagatattgtctccgtctatcaacgcaaagatcgaatccatctgcaatagttctgatcttccactgcctcagatcgagaaacagaacaaaacagaggaggtgctctctggtttttccaaaccggagaaagaaccggaatttggggagatatacggatgcggatactcgggctcatctcctgagtcggatataacgttgttggatttctcaagcgactgtgtgaaagaagatgagagtttcttgatgggtttgcacaagtatccttctttggagattgattgggacgctatagagaaactcttc

SEQ ID NO: 623 - DNA, 1507 bp, Arabidopsis thaliana
  G440 cDNA Sequence
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 624 - protein, 354 aa, Arabidopsis thaliana
  G440 Amino Acid Sequence
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 625 - DNA, 1065 bp, Arabidopsis thaliana
  G440 Genomic Sequence
atggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaa

SEQ ID NO: 626 - DNA, 1065 bp, Arabidopsis thaliana
  G440 DNA sequence used for BLAST
ttaagcaactaatagatctgatatcaatgaatcatcaaaatcactaaacgttgaacccatatctttgatactagaacttgttaactcatcttcaatgttcatagtttcaccacccaagaacaacatatcattgaagatatcatcattttcacagaaaatttgatccattggttggtcaaatattgacatctctggtggtgattcattgaaatagttgtcaagaaacggagtatccaaaggaaatgaatcgtctgattcacctaaaccggtattaaacccggtatgccaccatggtgcatttgaaacccccggttcgggtttagctgatttaaacggttgttgtacttgttgaatctcttctgaccggtgattgagaaccgaagtaggagatgagagatgttgtaaatcttcttcagttgattcagaactcgatgttgttggtgttggcgtcgtcataataaccggtttctcctcaataaccggttccggttcttcttcttcttcctcttcttgaggcggtatggagaaattagttaaagcgtccggtccacggagtcttatagcggcgttatcataaaccacggcagcttcctccgccgtctcaaaagtcccgagccaaatcctccgacgttgctccggatctctaatctccgccgcccatttcccccatggccgttgtctaacaccacggaacttctttatctgaccggagactgaaactttgttattaggacgttgacgactcgacgccggagattgagtttcatcggaggaagaagagagtctctttctatctttcatcgaaactccggtgacgacgttgttacagctaggctcaacagtgatctcgttaacgaatcttttgactctccggcgaggaaacaagaaatcttcttcgtcttcgtcacttgatgaatctgttgcgtcaggatcagtataacaaatactaacctttttcaatgacttaccaccggaaagtttttccgatgactttttggtgtatttagtcattgaagtcttgtgctctgtgtacttcaatggtcggaaatcaatatattcgtccat

SEQ ID NO: 627 - DNA, 960 bp, Arabidopsis thaliana
  G441 cDNA Sequence
cactcactgagtcaaactcacgtgtcaatgaccgagtcatccattatctccgtcaaacaatcgtctccggtgccggaggaggaggatcatcatcatcaccaacaagactcccaccgaaccaacaccaagaaacgtgtaagatccgacccgggttaccgaggcgtccggatgcgaacgtggggcaaatgggtctccgagatccgagagcctcgcaagaagagccgaatctggctaggcactttctccacaccggaaatggcggcgcgtgcacatgacgcagctgctctcaccattaaaggaacttccgccgtcctcaacttcccggagctcgccacttaccttccccgtccagcttcctcctctccacgcgacgttcaagccgcagccgccgtagcggccgccatggacttctccccctcctcctcctctctcgtagtctccgatccaaccaccgtcatcgccccagctgagacgcagttgtcttcctcgagctattcaacgtgtacgtcatcgtcgttgtcaccgtcaagcgaagaagctgcgtcgacggcggaagaactaagcgagatagtggagttaccgagtctagagacgagttacgatgagtcattgagcgagtttgtgtacgttgactcggcgtatccacctagttcgccttggtatattaataattgttatagcttttattaccacagcgacgaaaatggcatttcgatggctgaacctttcgactcttccaattttggccccctttttccttagttttatttttaaataatctcttcttttaaaaacatttagcctccaaacctctgaagtttatttaattattggattcagaccagagtttaatatacttgattaaacctgatagtaccatataatgtttattgctctcttttttttgatcggatcttctagatattttgtacgaacacgccaattgtgattggacgataa

SEQ ID NO: 628 - protein, 244 aa, Arabidopsis thaliana
  G441 Amino Acid Sequence
MTESSIISVKQSSPVPEEEDHHHHQQDSHRTNTKKRVRSDPGYRGVRMRTWGKWVSEIREPRKKSRIWLGTFSTPEMAARAHDAAALTIKGTSAVLNFPELATYLPRPASSSPRDVQAAAAVAAAMDFSPSSSSLVVSDPTTVIAPAETQLSSSSYSTCTSSSLSPSSEEAASTAEELSEIVELPSLETSYDESLSEFVYVDSAYPPSSPWYINNCYSFYYHSDENGISMAEPFDSSNFGPLFP

SEQ ID NO: 629 - DNA, 735 bp, Arabidopsis thaliana
  G441 Genomic Sequence
atgaccgagtcatccattatctccgtcaaacaatcgtctccggtgccggaggaggaggatcatcatcatcaccaacaagactcccaccgaaccaacaccaagaaacgtgtaagatccgacccgggttaccgaggcgtccggatgcgaacgtggggcaaatgggtctccgagatccgagagcctcgcaagaagagccgaatctggctaggcactttctccacaccggaaatggcggcgcgtgcacatgacgcagctgctctcaccattaaaggaacttccgccgtcctcaacttcccggagctcgccacttaccttccccgtccagcttcctcctctccacgcgacgttcaagccgcagccgccgtagcggccgccatggacttctccccctcctcctcctctctcgtagtctccgatccaaccaccgtcatcgccccagctgagacgcagttgtcttcctcgagctattcaacgtgtacgtcatcgtcgttgtcaccgtcaagcgaagaagctgcgtcgacggcggaagaactaagcgagatagtggagttaccgagtctagagacgagttacgatgagtcattgagcgagtttgtgtacgttgactcggcgtatccacctagttcgccttggtatattaataattgttatagcttttattaccacagcgacgaaaatggcatttcgatggctgaacctttcgactcttccaattttggccccctttttccttag

SEQ ID NO: 630 - DNA, 735 bp, Arabidopsis thaliana
  G441 DNA sequence used for BLAST
ctaaggaaaaagggggccaaaattggaagagtcgaaaggttcagccatcgaaatgccattttcgtcgctgtggtaataaaagctataacaattattaatataccaaggcgaactaggtggatacgccgagtcaacgtacacaaactcgctcaatgactcatcgtaactcgtctctagactcggtaactccactatctcgcttagttcttccgccgtcgacgcagcttcttcgcttgacggtgacaacgacgatgacgtacacgttgaatagctcgaggaagacaactgcgtctcagctggggcgatgacggtggttggatcggagactacgagagaggaggaggagggggagaagtccatggcggccgctacggcggctgcggcttgaacgtcgcgtggagaggaggaagctggacggggaaggtaagtggcgagctccgggaagttgaggacggcggaagttcctttaatggtgagagcagctgcgtcatgtgcacgcgccgccatttccggtgtggagaaagtgcctagccagattcggctcttcttgcgaggctctcggatctcggagacccatttgccccacgttcgcatccggacgcctcggtaacccgggtcggatcttacacgtttcttggtgttggttcggtgggagtcttgttggtgatgatgatgatcctcctcctccggcaccggagacgattgtttgacggagataatggatgactcggtcat

SEQ ID NO: 631 - DNA, 1080 bp, Arabidopsis thaliana
  G442 cDNA Sequence
caccacgtgtcttgtagccgtacatttaattgtcgtaagcaccacgcgtgttctcttagacggtatctagacatgtgttcccaccttaatttctgaaggctctggtgaattctaggacaatctatgcagacaaaaatttatagtttattgtttggttttatgttcgaaatttaatagtgattgtactgcgctccgtaatattttctacagtttgtacgtgttgtgtttttccaatggaaaaggaagataacggatcgaaacagagctcctctgcttctgttgtatcctcgagaagacgaagaagagtggttgagccagtggaagcgacgttacagagatgggaggaagaaggattggcgagagctcgtagggttcaagccaaaggttcgaagaaaggttgtatgagaggaaaaggtggaccagagaatcctgtttgtcggtttagaggtgttcgacaaagggtttgggggaaatgggttgctgagatacgtgaaccagtgagtcaccgtggtgcaaactctagtcgtagtaaacggctttggcttggcacgtttgctactgcagctgaagctgctttggcttacgacagagctgctagtgtcatgtacggaccctatgccaggttaaatttcccggaagatttgggtgggggaaggaagaaggacgaggaggcggaaagttcgggaggctattggttggaaactaacaaagccggtaatggcgtgattgaaacggaaggtggaaaagactatgtagtctacaatgaagacgctattgagcttggccatgacaagactcagaatcctatgactgataatgaaatagtgaacccagcagtgaaatcagaggaaggttacagctatgatcgattcaaattggataacggattgttgtataatgaacctcaaagctccagttatcaccagggaggtggattcgattcatattttgagtatttcagattctagcttaggatttatgctgcatcaatatactatgactatgagactatgttttttacattgttagtttactccattttcatttatcttaaaaaaaaaaaaaaaaaaaaaaaaaaaa

SEQ ID NO: 632 - protein, 244 aa, Arabidopsis thaliana
  G442 Amino Acid Sequence
MEKEDNGSKQSSSASVVSSRRRRRVVEPVEATLQRWEEEGLARARRVQAKGSKKGCMRGKGGPENPVCRFRGVRQRVWGKWVAEIREPVSHRGANSSRSKRLWLGTFATAAEAALAYDRAASVMYGPYARLNFPEDLGGGRKKDEEAESSGGYWLETNKAGNGVIETEGGKDYVVYNEDAIELGHDKTQNPMTDNEIVNPAVKSEEGYSYDRFKLDNGLLYNEPQSSSYHQGGGFDSYFEYFRF

SEQ ID NO: 633 - DNA, 735 bp, Arabidopsis thaliana
  G442 Genomic Sequence
atggaaaaggaagataacggatcgaaacagagctcctctgcttctgttgtatcctcgagaagacgaagaagagtggttgagccagtggaagcgacgttacagagatgggaggaagaaggattggcgagagctcgtagggttcaagccaaaggttcgaagaaaggttgtatgagaggaaaaggtggaccagagaatcctgtttgtcggtttagaggtgttcgacaaagggtttgggggaaatgggttgctgagatacgtgaaccagtgagtcaccgtggtgcaaactctagtcgtagtaaacggctttggcttggcacgtttgctactgcagctgaagctgctttggcttacgacagagctgctagtgtcatgtacggaccctatgccaggttaaatttcccggaagatttgggtgggggaaggaagaaggacgaggaggcggaaagttcgggaggctattggttggaaactaacaaagccggtaatggcgtgattgaaacggaaggtggaaaagactatgtagtctacaatgaagacgctattgagcttggccatgacaagactcagaatcctatgactgataatgaaatagtgaacccagcagtgaaatcagaggaaggttacagctatgatcgattcaaattggataacggattgttgtataatgaacctcaaagctccagttatcaccagggaggtggattcgattcatattttgagtatttcagattctag

SEQ ID NO: 634 - DNA, 735 bp, Arabidopsis thaliana; identical to SEQ ID NO: 633
  G442 DNA sequence used for BLAST

SEQ ID NO: 635 - DNA, 949 bp, Arabidopsis thaliana
  G443 cDNA Sequence
ctagacaaccacaagaacacaaaacacacaaaaacaaagaggttctttctttgaagaagaaatggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaaggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagatgtttgtttcgtcttgtaagaggctaaggatcatgaaaggatctgaagttaaaggtttaggttgtggtggtctttaacaaacctaattgagagataaagatcaaagagaaagattcaaaaacagagttttttgttctgtttcttgaaacagagtaaatatagctctgaaactgctcgggttcttggggagagatgtttcatacaatcatactttgtgaatgtttacctcatcggtaaaaagagagatgcttaaaatggtcttaagcataaaagtgtgagaaagatctaaatctaaactttagctgtaactctgtctccattaaagagaaaggttttgtggtattagaaagatctaatctgaagattatctttgtgtttttcactttttaaaaaaaaaaaaaaaa

SEQ ID NO: 636 - protein, 186 aa, Arabidopsis thaliana
  G443 Amino Acid Sequence
MEKVDVYDELVNLKATELRLGLPGTEETVSCGKSNKRVLPEATEKEIESTGKTETASPPKAQIVGWPPVRSYRKNNVQTKKSESEGQGNYVKVSMDGAPYLRKIDLTMYKQYPELMKSLENMFKFSVGEYFEREGYKGSDFVPTYEDKDGDWMLVGDVPWEMFVSSCKRLRIMKGSEVKGLGCGGL

SEQ ID NO: 637 - DNA, 742 bp, Arabidopsis thaliana
  G443 Genomic Sequence
atggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaagtaagtgtttgaatcaaatacaacttctctgaaaatgtgtgttgagttgtgaatctgatctaatctaatctatgctatttcttgttttatagggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagtaagtacaaattttcatttatctctcaaattagttaacttatgacacaatcttgtttatgtatttatggtgttttgttgttattgcaggatgtttgtttcgtcttgtaagaggctaaggatcatgaaaggatctgaagttaaaggtttaggttgtggtggtctttaa

SEQ ID NO: 638 - DNA, 745 bp, Arabidopsis thaliana
  G443 DNA sequence used for BLAST
atggaaaaagttgatgtttatgatgagcttgttaacctaaaggcaacagagctgagattgggattaccagggacagaagaaactgtttcttgtggaaaaagcaacaaaagagttttacctgaagctactgagaaagagattgaatccactggaaaaactgaaaccgcttctcctccaaagtaagtgtttgaatcaaatacaacttctctgaaaatgtgtgttgagttgtgaatctgatctaatctaatctatgctatttcttgttttatagggctcagattgttggatggccaccagttagatcttacagaaagaacaatgttcagacaaagaagagtgaatctgaaggtcaaggaaactatgtgaaagtaagtatggatggtgctccatatctaaggaagatagatctaacgatgtataaacaatatccagagttgatgaaatcacttgaaaacatgtttaaattctctgtgggagaatattttgagagagaaggatataaaggctcagactttgtacctacttatgaagacaaagatggtgattggatgcttgttggtgatgttccttgggagtaagtacaaattttcatttatctctcaaattagttaacttatgacacaatcttgtttatgtatttatggtgttttgttgttattgcaggatgtttgtttcgtcttgtaagaggctaaggatcatgaaaggatctgaagttaaaggtttaggttgtggtggtctttaacaa

SEQ ID NO: 639 - DNA, 1240 bp, Arabidopsis thaliana
  G444 cDNA Sequence
tctccaatttctattctctctctctttaagaaaaattccttgtttttgatccgagaatcgaagtcgccctcgaatcaagattaaaacctcgtttagttctcaatttcagttctgtggatccgtgcgtgacctcaagttttttttttttttctgtctcgaaattcagaatcgtagaggtgttgaaagttgaaaccttttttttggtttgcttggttaatgggtttcttcaaacttgatcgataattggatttgaatcaagggttttagtgttcttgctttgtgtattcgtttggcaatttgggataatgaatggtttgcaagaagtttgttcgtcaagtgggtcggtgatgatcggactaccagctgaagaagacgaaaacgccgcacattcgtcggaggattcatcttgccccgacgagtcagtgtcagagacagagctcgacctagctttgggtcttagcattggtcgtcggaaggttcgatcgtctttgtcttcctcgtcttcttctctgaccagggaaagtgggaccaaacgctctgctgattcttctccggctgccgcctcaaacgcaaccagacaagttgctgtaggttggccgcctctacggacttacagaatcaacagtttggtcaatcaagcaaagtctttagctacggaaggcggcttgagttctggcattcaaaaggagactacaaaaagtgtagtggttgctgctaagaacgatgatgcttgctttatcaaatcgtccaggacttctatgcttgtgaaggtgacaatggacggagttataattggaaggaaggttgatctcaatgctctggattcttatgcagccttagagaaaactttggatctaatgtttttccagattccttctcctgtaacaagatccaacacacaaggatacaagacaattaaggaaacatgtacttcgaaattactggatggctcatcggaatatatcataacatatcaagataaagacggagattggatgcttgtaggagatgttccttggcagatgttcctcgggtctgtgacaagactgagaatcatgaagacatcaattggagctggagtaggtaagtagagagtcctatatagcaaaaacagtttacatctctttggtctgtaactcatatatcacattcacatatatacatgtgcatatgtttatacatgagtgtacatatgtcttctcgtcgtttgtgaatatcaaacaacagcttaaccttctca

SEQ ID NO: 640 - protein, 261 aa, Arabidopsis thaliana
  G444 Amino Acid Sequence
MNGLQEVCSSSGSVMIGLPAEEDENAAHSSEDSSCPDESVSETELDLALGLSIGRRKVRSSLSSSSSSLTRESGTKRSADSSPAAASNATRQVAVGWPPLRTYRINSLVNQAKSLATEGGLSSGIQKETTKSVVVAAKNDDACFIKSSRTSMLVKVTMDGVIIGRKVDLNALDSYAALEKTLDLMFFQIPSPVTRSNTQGYKTIKETCTSKLLDGSSEYIITYQDKDGDWMLVGDVPWQMFLGSVTRLRIMKTSIGAGVGK

SEQ ID NO: 641 - DNA, 1218 bp, Arabidopsis thaliana
  G444 Genomic Sequence
ctacttacctactccagctccaattgatgtcttcatgattctcagtcttgtcacagacccgaggaacatcctgagaagatgaaaagatcgttttcattgaaatggatgtgccacattacaaatacagatgatgaatgggaagttataagggtagtcacttactgccaaggaacatctcctacaagcatccaatctccgtctttatcttgatatgttatgatatattccgatgagccatccagtaatttcgaagtacatgtttccttaattgtcttgtatccttgtgtgttggatcctacaaatcgatcaatcaaaaccagtcaatttcaagagacacagaatttgaaaaacagaatcacatggaatctcatgaaacagaattagtaactgacttgttacaggagaaggaatctggaaaaacattagatccaaagttttctctaaggctgcataagaatccagagcattgagatcaaccttccttccaattataactccgtccattgtcaccttcacaagcatagaagtcctggacgatttgataaagcaagcatcatcgttcttagcagcaaccactacactttttgtagtctccttttgaatgccagaactcaagccgccttccgtagctaaagactttgcttgattgaccaaactgttgattctgtaagtccgtagaggcggccaacctacagcaacttgtctgctccattaccaaaagatattaaatcaaaagacgaacaagtataaaccaatatgattcaaaagtttaactaaacatttcagggaacactctatttgattcaatcctgtgattcattcattctcaaagtttaaggtctaaaagctctatcctctaagttgctttgattctgtaacaataagcaatctgagaccaatcattcatataggttataatataaagtctcgaagatgaattttttacctggttgcgtttgaggcggcagccggagaagaatcagcagagcgtttggtcccactttccctggtcagagaagaagacgaggaagacaaagacgatcgaaccttccgacgaccaatgctaagacccaaagctaggtcgagctctgtctctgacactgactcgtcggggcaagatgaatcctccgacgaatgtgcggcgttttcgtcttcttcagctggtagtccgatcatcaccgacccacttgacgaacaaacttcttgcaaaccattcat

SEQ ID NO: 642 - DNA, 1218 bp, Arabidopsis thaliana; identical to SEQ ID NO: 641
  G444 DNA sequence used for BLAST

SEQ ID NO: 643 - DNA, 971 bp, Arabidopsis thaliana
  G448 cDNA Sequence
tttccatcttcctcatcaccttcccaagaagaagaacaccaaagaagaagaaaggttaataatgatgggcagtgtcgagctgaatctgagggagactgagctgtgtcttggtcttcccggtggagatacagtggctccggtaaccggaaacaagagagggttctcagagacggttgatctgaagctaaatctgaataatgagcctgcaaacaaggaaggatctacgactcatgacgtcgtgacttttgattccaaggagaagagtgcttgtcctaaagatccagccaaacctccggccaaggcacaagttgtgggatggccaccggtgagatcataccggaagaacgtgatggtttcctgccaaaaatcaagcggtggcccggaggcggcggcgttcgtgaaggtatcaatggacggagcaccgtacttgaggaaaatcgatttgaggatgtataaaagctacgatgagctttctaatgctttgtccaacatgttcagctcttttaccatgggcaaacatggaggagaagaaggaatgatagacttcatgaatgagaggaaattgatggatttggtgaatagctgggactatgttccctcttatgaagacaaagacggtgattggatgctcgtcggcgacgttccttggccaatgttcgtcgatacatgcaagcgtttacgtctcatgaaaggatcggatgccattggtctcgctccgagggcgatggagaagtgcaagagcagagcttgaagtcaaattaaaaggataagtggtatcgattatatatttgattaacacattgattggtgttaattgctctttttttttcttacgatgaaatacattgttcagtttcttttgattgtctgtgttttgatctggatttggtatgtagatatagtttgtatgctattatgtgtaatgaacttaagttaaatatttgagacatttgtaatggaaaatgtgtaat

SEQ ID NO: 644 - protein, 229 aa, Arabidopsis thaliana
  G448 Amino Acid Sequence
MMGSVELNLRETELCLGLPGGDTVAPVTGNKRGFSETVDLKLNLNNEPANKEGSTTHDVVTFDSKEKSACPKDPAKPPAKAQVVGWPPVRSYRKNVMVSCQKSSGGPEAAAFVKVSMDGAPYLRKIDLRMYKSYDELSNALSNMFSSFTMGKHGGEEGMIDFMNERKLMDLVNSWDYVPSYEDKDGDWMLVGDVPWPMFVDTCKRLRLMKGSDAIGLAPRAMEKCKSRA

SEQ ID NO: 645 - DNA, 1959 bp, Arabidopsis thaliana
  G448 Genomic Sequence
tcaagctctgctcttgcacttctccatcgccctcggagctgaaatatttttacaattaataagcaaagacatttgaccacggtatttattctgttaaaagagtatattttttattccctctgttatttaatctctttctttttttgcatttgacaaaagagaatcaaatatcatgtattatatcaatgatttaaaagatcaaagcgataagttttctttcgacaaatttgttctttacggtagaaatataattgtgcgaaaaataatgaacggtttaagcgtttgatgattagacatcatcttaaacgatagcatattaaattatttaggcgaccaagttatgcggttgaggtgtacattatagtaaacttttaagctcttttgtaagttttttttttctttttggggcaaatctcttttgtaagctattttaactatattgtatacatatacacgtaaattttaatttaaatgggtaacaaactgaaatcaaaatttaatcaatgtgaatataatatgcattggtagaaaatacataccgagaccaatggcatccgatcctttcatgagacgtaaacgcttgcatgtatcgacgaacattctaataaataaaaagattaaaacaaatggttatttattagaaacaaataaatgacataaacaaaaataaagctcgaattttaaccgaaacaataaagctctaattaaatggtaattaataagggagaagaagaagacgtacggccaaggaacgtcgccgacgagcatccaatcaccgtctttgtcttcataagagggaacatagtcccagctattcaccaaatccatcaatttcctctcattcatgaagtctatcattccttcttctcctccatgtttgcctaaaataatcttaggtataagaacttgatatcctgaatttaaacttggtggttttcttttatggtgcaacaaatgaaatatacatttttcgcaattggattttatcacatagttttcttttcacagtttctaaactactactaacgggttactcaattatgaaatatttgtatactcgataacggtaattcatttgggactgatctatcatcatgatgattaatttttctttctatagtaacaattaattagtaactaaatgtgcatggaaggatctacatatatatataaggaatatacttataaaacgtacccatggtaaaagagctgaacatgttggacaaagcattagaaagctcatcgtagcttttatacatcctcaaatcgattttcctcaagtacggtgctccgtccattgataccttcacgaacgccgccgcctccgggccaccgcttgatttttggcaggaaaccatcacgttcttccggtatgatctcaccggtggccatcccacaacttgtgccctatattttttttaaaacggaaaaacggttatgttatacaagatatagactgtagttagctttgacgtgatgtcacataaattttacttgcatgagactatgggttaaacataattaaatatattaagacattggacgatttaagaagagaaaaaaaccgtagacatatgataaaatggttttggcgaagaaaaatatatatctttaatgaaatttctgtttttttttgcagtcacctttacaaaaatgttaatattaagagcagtagagaagagtggaaaataaatcataaaggacaaaatagtaaaattacttggccggaggtttggctggatctttaggacaagcactcttctccttggaatcaaaagtcacgacgtcatgagtcgtagatccttccttgtttgcaggctcattattcagatttagcttcagatcaaccgtctctgagaaccctctcttgtttccggttaccggagccactgtatctccaccgggaagaccaagacacagctcagtctccctcagattcagctcgacactgcccatcat

SEQ ID NO: 646 - DNA, 1959 bp, Arabidopsis thaliana; identical to SEQ ID NO: 645
  G448 DNA sequence used for BLAST

SEQ ID NO: 647 - DNA, 977 bp, Arabidopsis thaliana
  G449 cDNA Sequence
agcttctctatatctctcctctctttcaaggataataaccaaaagcttttctttttatcttctcctgcaattcttgaagaaatggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaaggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagatgttcatatgtacgtgcaagagactaaggatcatgaaaggatcagaagccaaaggtttaggctgtggtgtatgagatatatcttcaagaaatctaacagagacacaaaagaacttgaagaaaaatagagtttcttttggttcagagaaatctctgtctgtgcttgggttgtcgggtttctcgggcaagatctatgttcattggattgaatccaattcatagcctttatttacctcatcggtaaaattcaaatgtaaacatgcttaatggtcttaagcatatgaaactggaacctaattacattttgtttcagaaacagggcaaaaggttgtccttaaatctttggttatgtgtattacattaattaaagtgttatgaagattgaagagttgtttttaaaa

SEQ ID NO: 648 - protein, 189 aa, Arabidopsis thaliana
  G449 Amino Acid Sequence
MDEFVNLKETELRLGLPGTDNVCEAKERVSCCNNNNKRVLSTDTEKEIESSSRKTETSPPRKAQIVGWPPVRSYRKNNIQSKKNESEHEGQGIYVKVSMDGAPYLRKIDLSCYKGYSELLKALEVMFKFSVGEYFERDGYKGSDFVPTYEDKDGDWMLIGDVPWEMFICTCKRLRIMKGSEAKGLGCGV

SEQ ID NO: 649 - DNA, 756 bp, Arabidopsis thaliana
  G449 Genomic Sequence
atggatgagtttgttaacctcaaggaaacagagctgaggctgggattaccgggaacagataatgtatgtgaagcaaaagagagagtttcttgctgtaataacaacaataagagagtactatcaactgatactgagaaggagattgaatcatcatcaaggaaaactgaaacatcccctcctcgaaagtaagttaaactcacacaaaagtctctgaatctgtagtggtggagaattcagttgattgaccgtgtttcttcctttttgcagggctcagattgttggatggccaccagttagatcttacaggaagaacaacattcagagtaagaagaatgaatctgagcatgagggtcaaggaatctatgtgaaagtaagtatggatggtgcaccatacttgaggaaaatagatctgagttgttacaaaggatactcagagttgcttaaagctttagaagtgatgttcaaattctctgtgggagagtactttgagagagatggatataaaggttcagactttgtgcctacttatgaagacaaagatggtgattggatgctcattggtgatgttccatgggagtaagtcttctttcatatacctgtctgaaaacaatttccacaaaatcaaaaatcagaaacaacaattttgtaagtgttcttatgggttctgtttgttgttgcaggatgttcatatgtacgtgcaagagactaaggatcatgaaaggatcagaagccaaaggtttaggctgtggtgtatga

SEQ ID NO: 650 - DNA, 756 bp, Arabidopsis thaliana; identical to SEQ ID NO: 649
  G449 DNA sequence used for BLAST

SEQ ID NO: 651 - DNA, 697 bp, Arabidopsis thaliana
  G451 cDNA Sequence
tcaagaattaaggaagagagcttcttcgttaaagtatagtgagagaatatggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaaaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatgatccattgtctcaaaacaccttttggtcgaggcaaaaacaaattctactttgtttagataaaaaaaagtttggtgtaaagaaagaaaaagcaatagggttacaaatacgttatatagatgtaaactagctttggttaattctg

SEQ ID NO: 652 - protein, 168 aa, Arabidopsis thaliana
  G451 Amino Acid Sequence
MEVTNGLNLKDTELRLGLPGAQEEQQLELSCVRSNNKRKNNDSTEESAPPPAKTQIVGWPPVRSNRKNNNNKNVSYVKVSMDGAPYLRKIDLKMYKNYPELLKALENMFKFTVGEYSEREGYKGSGFVPTYEDKDGDWMLVGDVPWDMFSSSCQKLRIMKGSEAPTAL

SEQ ID NO: 653 - DNA, 599 bp, Arabidopsis thaliana
  G451 Genomic Sequence
atggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaagtaagttgagatctgaaagttatagttttaatatccaaacttcttgatatcaatcggtgtactaataatgaatcttgatttgtaaacttcagaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatga

SEQ ID NO: 654 - DNA, 599 bp, Arabidopsis thaliana; identical to SEQ ID NO: 653
  G451 DNA sequence used for BLAST

SEQ ID NO: 655 - DNA, 951 bp, Arabidopsis thaliana
  G452 cDNA Sequence
tccgcaagaacaagaacaagaagaagaagaacaagacaagaagaacaaagtacccaagaaaacacacagggaaggaaacacaaagattgatattgatccaaaagcaatggcgtacgagaaagtcaacgagcttaaccttaaggacacagagctatgtcttggattacccggaagaacagagaagatcaaagaagaacaagaggtttcttgcgttaaaattaacaacaagcgtctatttgaggaaactcgtgatgaagaagaatctacacctcctaccaaaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatgatccagagaagctgagaatcttttgtctaaaaaggagatgatgactatgatcgatgaatgaaaaaccctttttggtttgattcggatcggagtttgactaaagttgaccgtgaaagacgaaacttcggggttttgtccgacgagagatccatctctagtgatgttctttttgtttttgtatttagatttgaagtttgatgtaaagatacatgagattttatgtataatacggacacatacacaatctatagatgtataatgtattaagtagttatgtcctataagatcatcagttttctgttaaaaaaaaaaaaaaaaaaa

SEQ ID NO: 656 - protein, 174 aa, Arabidopsis thaliana
  G452 Amino Acid Sequence
MAYEKVNELNLKDTELCLGLPGRTEKIKEEQEVSCVKINNKRLFEETRDEEESTPPTKTQIVGWPPVRSSRKNNNSVSYVKVSMDGAPYLRKIDLKTYKNYPELLKALENMFKVMIGEYCEREGYKGSGFVPTYEDKDGDWMLVGDVPWDMFSSSCKRLRIMKGSDAPALDSSL

SEQ ID NO: 657 - DNA, 1018 bp, Arabidopsis thaliana
  G452 Genomic Sequence
caagaacaagaacaagaagaagaagaacaagacaagaagaacaaagtacccaagaaaacacacaagaaggaaacacaaagattgatattgatccaaaagcaatggcgtacgagaaagtcaacgagcttaaccttaaggacacagagctatgtcttggattacccggaagaacagagaagatcaaagaagaacaagaggtttcttgcgttaaaattaacaacaagcgtctatttgaggaaactcgtgatgaagaagaatctacacctcctaccaagtaagtagaagagatctgagtttcaaattggcttctttcaaattattggctcttgaatagttttactaatctttctttcctcaaatttacagaactcaaatcgttggttggccaccagtgagatcttcccgtaagaacaacaacagtgtgagctacgtgaaagtgagtatggacggagctccttaccttcgcaagatcgatctcaagacatacaaaaactaccccgagcttctcaaagcgttagagaatatgttcaaagtcatgattggtgaatattgtgagagagaaggatacaaaggatctggatttgtaccaacatacgaagataaagatggtgactggatgttggttggtgatgttccatgggacatgttctcttcttcttgtaagagactcagaatcatgaagggatccgacgctcctgctctagactcttccttatgatccagagaagctgagaatcttttgtctaaaaaggagatgatgactatgatcgatgaatgaaaaaccctttttggtttgattcggatcggagtttgactaaagttgaccgtgaaagacgaaacttcggggttttgtccgacgagagaatccatctctagtgatgttctttttgtttttgtatttagatttgaagtttgatgtaaagatacatgagatttatgtataatacggacacatacacaatctatagatgtataattattaagtagttatgtcctataagatcatcagttttctgtt

SEQ ID NO: 658 - DNA, 617 bp, Arabidopsis thaliana
  G452 DNA sequence used for BLAST
tcataaggaagagtctagagcaggagcgtcggatcccttcatgattctgagtctcttacaagaagaagagaacatgtcccatggaacatcaccaaccaacatccagtcaccatctttatcttcgtatgttggtacaaatccagatcctttgtatccttctctctcacaatattcaccaatcatgactttgaacatattctctaacgctttgagaagctcggggtagtttttgtatgtcttgagatcgatcttgcgaaggtaaggagctccgtccatactcactttcacgtagctcacactgttgttgttcttacgggaagatctcactggtggccaaccaacgatttgagttctgtaaatttgaggaaagaaagattagtaaaactattcaagagccaataatttgaaagaagccaatttgaaactcagatctcttctacttacttggtaggaggtgtagattcttcttcatcacgagtttcctcaaatagacgcttgttgttacttttaacgcaagaaacctcttgttcttctttgatcttctctgttcttccgggtaatccaagacatagctctgtgtccttaaggttaagctcgttgactttctcgtacgccat

SEQ ID NO: 659 - DNA, 899 bp, Arabidopsis thaliana
  G455 cDNA Sequence
tttctaatctattacaagtaacatgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaaagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggaaactatggagcacaaggaatgatagatttcatgaacgagagcaagctaatgaatctgctgaatagctctgagtatgtgccaagctacgaggacaaagatggtgactggatgctcgttggcgatgtcccatgggaaatgtttgtcgagtcttgcaaacgtttgcgcattatgaagggatctgaagcagttggacttgctccgagagcaatggagaagtactgcaagaacagatcttgaattaataataaaaaaaaagaagcatcaatgatcaacaatatgacgggttcttgattttatatgtatttttatgattgtatgtggctatcacctatatatgtgtgttgtaattttaaatacttgatgggtatatagggcagtattt

SEQ ID NO: 660 - protein, 243 aa, Arabidopsis thaliana
  G455 Amino Acid Sequence
MIGQLMNLKATELCLGLPGGAEAVESPAKSAVGSKRGFSETVDLMLNLQSNKEGSVDLKNVSAVPKEKTTLKDPSKPPAKAQVVGWPPVRNYRKNMMTQQKTSSGAEEASSEKAGNFGGGAAGAGLVKVSMDGAPYLRKVDLKMYKSYQDLSDALAKMFSSFTMGNYGAQGMIDFMNESKLMNLLNSSEYVPSYEDKDGDWMLVGDVPWEMFVESCKRLRIMKGSEAVGLAPRAMEKYCKNRS

SEQ ID NO: 661 - DNA, 1949 bp, Arabidopsis thaliana
  G455 Genomic Sequence
atgatcggccaacttatgaacctcaaggccacggagctctgtctcggcctccccggcggcgctgaagcagttgagagtcctgccaaatcggcggtgggaagcaagagaggcttctccgaaaccgttgatctcatgctcaatcttcaatctaacaaagaaggctccgttgatctcaaaaacgtttctgctgttcccaaggagaagactacccttaaagatccttctaagcctcctgctaagtaagctacacatttacatatatatatattcttagattttttttttttttggttaaaaagttcttagttttttccagtccatatatatacatatatacgtgtttatacacatctatgtctaagttcttagaatattcgaatatatataaatttcatagttatatgtcctcgcagaacataaatattgtgagggatttacataaacatatgaataaactaaaaattcttgaaatttgtaatgttagttatatatatatatatatatatatatatatatatatatatacttcccatatacattacctttttttgttaaaatttatatgcataactttgattctttgaagttatatttgttttctatcaatataatactaagaaataatataataataattaaagcgtggttgaaacttaaacaccaatacatacatgcgtacaagcaaacatgaaataatacatgttataacttacaatcaagcccataaaggcagtaatggtaactaataattacattggttgatatacacctatctaaataatgttgttctatgtagagcacaagtggtgggatggccacctgtgaggaactacaggaagaacatgatgactcagcagaagaccagtagtggtgcggaggaggccagcagtgagaaggccgggaactttggtggaggagcagccggagccggcttggtgaaggtctccatggacggtgctccatatctgaggaaagttgacctcaagatgtacaaaagctaccaggatctttctgatgcattggccaaaatgttcagctcctttactatgggtacgtattagaaatttcaaatcggaaagtgtgaaaaaactatattcgtatattaaagtatatcatttactacatttattcatacaaaactcatgaaccttaccgagttagagtcatagaactatacattcgaaccctatacatattaacaagatgagattttgctaaatgtatacaacttaaatatgtattatatatattacacaataatgacacataaatttatatgatttttgaatgtcttgaatatcttcaaggaaactatggagcacaaggaatgatagatttcatgaacgagagcaagctaatgaatctgctgaatagctctgagtatgtgccaagctacgaggacaaagatggtgactggatgctcgttggcgatgtcccatgggagtgagtcaaatttaatcgtttcatatacttttttttataacttataacttgactcgttaaccacatttcccgaaattggtagagacaaagccaaagatattcaacatccatgtgttataaatacgtacaaccatgcattggttggcaagagacaagaggatctttcaaaaattatacaatagtatcgatatgtttagagctcattcgtagctggcacatcatcatattattgccaaaaaccttagaataaactttaaatgttaacgactcatattctaatgttctaaccgtaaacttgaatacctatttcagaatgtttgtcgagtcttgcaaacgtttgcgcattatgaagggatctgaagcagttggacttggtacatctctaactttttttttttttttttgtttttcaatttttaccaattttctttttattttaatataattctgttttcttggttatagctccgagagcaatggagaagtactgcaagaacagatcttga

SEQ ID NO: 662 - DNA, 1949 bp, Arabidopsis thaliana; identical to SEQ ID NO: 661
  G455 DNA sequence used for BLAST

SEQ ID NO: 663 - DNA, 1169 bp, Arabidopsis thaliana
  G456 cDNA Sequence
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 664 - protein, 236 aa, Arabidopsis thaliana
  G456 Amino Acid Sequence
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 665 - DNA, 1423 bp, Arabidopsis thaliana
  G456 DNA sequence used for BLAST
tcaacttctgttcttgcacttttctaatgcccttggagctgcaatatatagaaaattagtattagcaaagattcatagtataattttacaccaccagttttggattaaacaatactaaccaagtccgattgcttctgatcccttcattattcgtatacgtttgcatgaatcaacaaacatcctaaaatagtccaaacaacatgtaaataaatattttgtatagacgtatttataataataattcatatataaatttaaagatataaaaatactcactcccacggtacgtctcctacaagcatccagtcgccatctttatcttcatatgttggaacataatctgatccgtttagaagatcgatcaatttactctcattcatgaaatctttcattccttgtggtccatagttgcctgaaaaataaaatttcaaatttcaaacaatatatgataaaaaggatcatgttttagtagatagatatattgtcaatttttatttacctatggtaaaagagctaaacattttgcttaaggcgttggagagatcttggtaagttttgtagagtttcaagtcaattttccgtaggtacggtgcaccgtccatgctaaccttcacataagccacggtggcacatgcggaggcggatgaggtggctccactgctgccagaagtcttatcgtttccttcggtggcatctccggtggtcggtttttggccggacatgacgttcttgcggaaagatcgtaccggtggccatcccacaacttgtgccctgaaatttcgtaatgattttttttttttaatttcaataatactcattacttcttttttttgtaaaatgtttgtaaatgatctagttgttctacacgtgtcggatgttaggtggttgtagttgtccaaaagtttatttaatctttaatctttttggtagataaagaaagattccttatgttttgtatttttctagttcttcccgacaaaaaaataatcaaacagactctcaacctaactacaattgaaacatggagcaaaaccaaataaaaaacaaagatcttaggagaagtatcagcataattattccgttcgagttccctaacctagctagaaatcatgttaaagcgtatacatctctacataatgaccgcctagtataacctaattttaccgaacctagaagacaatattattagttgaaatagagattgaaattcagtttcttacttggctggtggttttacgaccttctccttcatattctctaaatcgactttggaaactgaatccatagccgtcgatgaaagattcagtttgagatcaacagtctcagaaaatcctcttttaccattattttttccagccatttctcctccgtgattcccacccggtagccctaatctcagctccgtggcctcaaaattaatcat

SEQ ID NO: 666 - DNA, 590 bp, Arabidopsis thaliana
  G459 cDNA Sequence
aaacatcaaagatggcgaatgagagtaataatcttggactcgaaatcaccgaactacggctaggtcttcccggagatatcgtcgtctccggtgagtccatctccgggaagaagagggcttctccggaagtagagattgatttgaaatgtgaaccggcgaaaaagagtcaagttgtgggttggccaccggtttgttcgtaccggagaaagaacagtctcgaacggaccaaaagttcgtacgtgaaagtgagtgtagatggagctgcatttttaaggaagattgatttggaaatgtacaaatgttaccaagatcttgcttccgctctgcaaattctgttcggatgctatatcaattttgatgatacgttgaaggaaagtgaatgtgtaccaatatatgaagacaaagatggagattggatgcttgctggagatgttccttgggaaatgttccttggatcgtgcaagaggttaaggattatgaagagatcatgtaacagaggatgaatgatatttatagtcacatgtgaatgtgagtgagccttacagatatctaaatatacatttttgcagttaataaaaaaaaaaaaaaaa

SEQ ID NO: 667 - protein, 163 aa, Arabidopsis thaliana
  G459 Amino Acid Sequence
MANESNNLGLEITELRLGLPGDIVVSGESISGKKRASPEVEIDLKCEPAKKSQVVGWPPVCSYRRKNSLERTKSSYVKVSVDGAAFLRKIDLEMYKCYQDLASALQILFGCYINFDDTLKESECVPIYEDKDGDWMLAGDVPWEMFLGSCKRLRIMKRSCNRG

SEQ ID NO: 668 - DNA, 720 bp, Arabidopsis thaliana
  G459 Genomic Sequence
tcacatgtgactataaatatcattcatcctctgttacatgatctcttcataatccttaacctcttgcacgatccaaggaacattctgcacacaaatagtttcataatttattagatatcaattaaataaaagaaagtaaatttgaatgttatagaggtcgctagaaacttactcccaaggaacatctccagcaagcatccaatctccatctttgtcttcatatattggtacacattcactttccttcaacgtatcatcttcattttcatatataaagattataaagttaatatcgatgttttggatcattagttgccttgataagtaaagactaaaaccaaaaatatatactatatatagaaacataaactaaccaaaattgatatagcatccgaacagaatttgcagagcggaagcaagatcttggtaacatttgtacatttccaaatcaatcttccttaaaaatgcagctccatctacactcactttcacgtacgaacttttggtccgttcgagactgttctttctccggtacgaacaaaccggtggccaacccacaacttgactctttttcgccggttcacatttcaaatcaatctctacttccggagaagccctcttcttcccggagatggactcaccggagacgacgatatctccgggaagacctagccgtagttcggtgatttcgagtccaagattattactctcattcgccat

SEQ ID NO: 669 - DNA, 720 bp, Arabidopsis thaliana; identical to SEQ ID NO: 668
  G459 DNA sequence used for BLAST

SEQ ID NO: 670 - DNA, 764 bp, Arabidopsis thaliana
  G461 cDNA Sequence
agaaaaaagagaagaaataaatggcaaaggaaggtctagcactcgagatcacagagcttcgattgggtcttccaggagataattatagcgaaatatcagtatgcggatcgagtaagaagaataagagggtgctctcggatatgatgacctcatcagcgttagatactgagaatgaaaacagcgtcgtttcatcagttgaagatgaatcactgccggttgtgaagagtcaagcggtgggatggccacctgtgtgttcttacaggagaaagaagaacaatgaggaagcatcgaaagctataggctacgtgaaagtgagcatggatggtgtgccatacatgaggaagattgaccttggttcgagcaacagttatattaatctagtcacggttcttgagaatctcttcggctgtcttggcataggagtggcgaaggagggtaagaagtgtgaatacattattatatacgaagacaaggatagagactggatgctcgtcggagatgtaccttggcagatgtttaaagaatcatgcaagaggctgaggatcgtgaagagatcagatgcaactggttttggtctccagcaagattaatcatactagctagtgttgatcatctttaattaaccataaagtttgaaaaccgttgagtaattttttttcattataatcatttttcaaattgtaaaatttatatgataatgatgatatatacgttttcttcaaatgtatttccttactggtcgtatcatactttaatgttttatg

SEQ ID NO: 671 - protein, 189 aa, Arabidopsis thaliana
  G461 Amino Acid Sequence
MAKEGLALEITELRLGLPGDNYSEISVCGSSKKNKRVLSDMMTSSALDTENENSVVSSVEDESLPVVKSQAVGWPPVCSYRRKKNNEEASKAIGYVKVSMDGVPYMRKIDLGSSNSYINLVTVLENLFGCLGIGVAKEGKKCEYIIIYEDKDRDWMLVGDVPWQMFKESCKRLRIVKRSDATGFGLQQD

SEQ ID NO: 672 - DNA, 890 bp, Arabidopsis thaliana
  G461 DNA sequence used for BLAST
ttaatcttgctggagaccaaaaccagttgcatctgatctcttcacgatcctcagcctcttgcatgattctttaaacatcctgccgacaaaaaaaatttacaatttaaaaaataaaattacaaatttttgacttgtaagaggttaattatattcattttggtaaatttgataattgagcattgtaatgcaagctaaacataaacttactgccaaggtacatctccgacgagcatccagtctctatccttgtcttcgtatataataatgtattcacacttcttaccctccttcgccactcctgcatagtttatatatacatgtgttatatttcataaagttccaactaatatatgtgttttactctcttcacacttccaatatatatagaaaccctaacaatacgtatatataaagtttatagctcaattataaacatggtcatgtaactattaactaacgttacgggaaattagtccatgccattactaacctatgccaagacagccgaagagattctcaagaaccgtgactagattaatataactgttgctcgaaccaaggtcaatcttcctcatgtatggcacaccatccatgctcactttcacgtagcctatagctttcgatgcttcctcattgttcttctttctcctgtaagaacacacaggtggccatcccaccgcttgactcttcacaaccggcagtgattcatcttcaactgatgaaacgacgctgttttcattctcagtatctaacgctgatgaggtcatcatatccgagagcaccctcttcttcttcttactcgatccgcatactgatatttcgctataattatctcctggaagacccaatcgaagctctgtgatctcgagtgctagaccttcctttgccat

SEQ ID NO: 673 - DNA, 779 bp, Arabidopsis thaliana
  G462 cDNA Sequence
ggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtgatgatgacttgaacaagaagcaaggagctggttcattaatttaatcttaaacttgatcatcaagatcctttagaacatttttcctattcatgttatataaatatatatgttatagtatattattttgcaacaaaatttcatgttaaaaaaaaaaaaaaaaaaaaa

SEQ ID NO: 674 - protein, 197 aa, Arabidopsis thaliana
  G462 Amino Acid Sequence
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVGLGYVKVSMDGVPYLRKMDLGSSQGYDDLAFALDKLFGFRGIGVALKDGDNCEYVTIYEDKDGDWMLAGDVPWGMFLESCKRLRIMKRSDATGFGLQPRGVDE

SEQ ID NO: 675 - DNA, 1279 bp, Arabidopsis thaliana
  G462 Genomic Sequence
atggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggttagtaacaattatgttctcttcccataaaagtagagtggtaattagatcatgtggaaaacaactaattatatatagtttacaagacgtccgattaagaacttagagtgttgtagtcttgtagacgtaatggagtagtatagtttagtgctgttctttctttttatgtctacaaccaaaccaacaccccaatttatgatacaatgacaacactaatacaaatatagttagaattttggttagcagttgaactgattgtggtagcaatgttatagattttaatttaaagtgttatgaaaggacaaatatgtcgagatttttattagtcatctcaggaaatttatttacttgttcttagagacttaagactagtcctaatttaactggttatttttctccaaactgttttgaattatctgaaaattatctatcatagaaaattagaggtttcggttactacatatccgtaatttctaaaaatcagaatttatgcaccacttgtatagttgtattgttaattagacttttctatataccgaattcgccatattatcaacacaattttaaatttacatatatacatatttgtgcaggtgtggccttgaaagatggtgacaactgcgaatacgttaccatatacgaagacaaagatggagactggatgctcgccggtgatgtaccttgggggtatgttctatcttttgacttaagatatctcactacaaaaagaaaatgtatcacaaactaaagtaaatgagtttggatattttgatttgcaggatgtttctagagtcatgcaagaggttgagaataatgaaaagatcggatgctaccgggtttgggctgcagcctagaggagtagacgagtga

SEQ ID NO: 676 - DNA, 1279 bp, Arabidopsis thaliana; identical to SEQ ID NO: 675
  G462 DNA sequence used for BLAST

SEQ ID NO: 677 - DNA, 1262 bp, Arabidopsis thaliana
  G463 cDNA Sequence
ctcgagctacgtcaggggtctctttctgtttgtttgttttcttgtttccttctctctctctctttctttctttgtcttcctttcccaggttgtttttttttgctctctctgccttcttgactttcaaaagactctttctttcttttggattgattttggattctagggctctctttcttttagtgggtttttgttgttgttgttgtggtctctctgatgattactgaacttgagatggggaaaggtgagagtgagcttgagcttggtctagggctgagtcttggcggtggaacggcggccaagattggtaaatcaggtggtggtggcgcgtggggagagcgtggaaggcttttgacggctaaggattttccttctgttggttctaaacgtgctgctgattctgcttctcatgctggttcatctcctcctcgttcaagtcaagttgttggatggcctcctatagggtcacacaggatgaacagtttggttaataaccaagctacaaagtcagcaagagaagaagaagaagctggtaagaagaaagtgaaagatgatgaacctaaagatgtgacaaagaaagtgaatgggaaagtacaagttggatttattaaggtgaacatggatggagttgctataggaagaaaagtggatttgaatgctcattcttcttacgagaatttggcgcaaacattggaagatatgttctttcgcactaatccgggtactgtcgggttaaccagtcagttcactaaaccgttgaggcttttagatggatcgtctgagtttgtacttacttatgaagataaggaaggagattggatgcttgttggtgatgttccatggagaatgttcatcaactcggtgaaaaggctacgtgtgatgaaaacctctgaagctaatggactcgctgcacgaaatcaagaaccaaacgagagacagcgaaagcagccggtttagatctcttttcgacgttacggtgttacaggttttatattttggggttttgcaagtctgagatacttctgaagcaagcataagctagattgatcttatatccagtttgtgtattttcttggttcttataatggtttttactggttttctttagtttttttttttgctgtcttttaattttcggttgcgatttcactatatactatggatggaagagaatgctctttatatcttttactacactgtaaatatttgaagcttatctaatatcgtttttaagggttaaaaaaccctgacgtagcctcgag

SEQ ID NO: 678 - protein, 246 aa, Arabidopsis thaliana
  G463 Amino Acid Sequence
MITELEMGKGESELELGLGLSLGGGTAAKIGKSGGGGAWGERGRLLTAKDFPSVGSKRAADSASHAGSSPPRSSQVVGWPPIGSHRMNSLVNNQATKSAREEEEAGKKKVKDDEPKDVTKKVNGKVQVGFIKVNMDGVAIGRKVDLNAHSSYENLAQTLEDMFFRTNPGTVGLTSQFTKPLRLLDGSSEFVLTYEDKEGDWMLVGDVPWRMFINSVKRLRVMKTSEANGLAARNQEPNERQRKQPV

SEQ ID NO: 679 - DNA, 1189 bp, Arabidopsis thaliana
  G463 Genomic Sequence
ctaaaccggctgctttcgctgtctctcgtttggttcttgatttcgtgcagctgcatatatattaacatgttttagtagaaatttttcattgcgtcatcttgagaaacaagaacaggaatcaagatgagattatctacataccgagtccattagcttcagaggttttcatcacacgtagccttttcaccgagttgatgaacattctaagataattccaacaaaaagaccatcagaaacatttattggaagtgtaagagataaataaacaaggtttttagatctattacctccatggaacatcaccaacaagcatccaatctccttccttatcttcataagtaagtacaaactcagacgatccatctaaaagcctcaacggtttagtgaactgactggttaacccgacagtacccggattagtgcgaaagaacatatcttccaatgtttgcgccaaattctcgtaagaagaatgagcattcaaatccacttttcttcctatagcaactccatccatgttcaccttaataaatccaacttgtactttcccattcactttctttgtcacatctttaggttcatcatctttcactttcttcttaccagcttcttcttcttctcttgctgactttgtagcttggttattaaccaaactgttcatcctgtgtgaccctataggaggccatccaacaacttgactgctacaaacaaagcaaacatcaagtcaggacttgtaatctatccaaatgaatcaaaaccaagaacagattcaactattcaagattcctaattccaaaccagagcatttcttccgacataactcagatcaagtatacatccaaacactaaagaatctttaagaaactcctaaacgaactatgttcagagaatagcaatttcacatcatacaaaaggaattaaacatcttaaaagatctttctttgaaaccaaaaagcttgaaaaagacgaaccttgaacgaggaggagatgaaccagcatgagaagcagaatcagcagcacgtttagaaccaacagaaggaaaatccttagccgtcaaaagccttccacgctctccccacgcgccaccaccacctgatttaccaatcttggccgccgttccaccgccaagactcagccctagaccaagctcaagctcactctcacctttccccatctcaagttcagtaatcat

SEQ ID NO: 680 - DNA, 1189 bp, Arabidopsis thaliana; identical to SEQ ID NO: 679
  G463 DNA sequence used for BLAST

SEQ ID NO: 681 - DNA, 989 bp, Arabidopsis thaliana; identical to SEQ ID NO: 24
  G464 cDNA Sequence

SEQ ID NO: 682 - protein, 207 aa, Arabidopsis thaliana
  G464 Amino Acid Sequence
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNGELKDVSMKVNPKVQGLGFVKVNMDGVGIGRKVDMRAHSSYENLAQTLEEMFFGMTGTTCRETVKPLRLLDGSSDFVLTYEDKGIGCLLEMFHGECLSTR

SEQ ID NO: 683 - DNA, 1229 bp, Arabidopsis thaliana
  G464 Genomic Sequence
ctaaacagggttgtttctttgtctatccttctgctcttgacgtcttggagctgcattaaaaatgattcaatcagtctttttcattagtcaagacgagaaatcaagaaaccagaagatgatctttaaaacttacctagtccactagcttctgaggttcccatgatccgaagccttttcaccgagttgataaacattctaaacaaaaagagagaaaagagactaatcaggttttgaactactgcaatactgcttaatatccgaatcttacctccatggaacatctccaacaagcatccaatccccttccttatcttcataagtgagtacaaagtctgatgatccatctaaaagccttaaaggtttaaccttttctcgacaagtagtacctgatagataaaacagaaactatcagtagattcatagaaaacatcgggtttatagtgtacgcatttgaaaacagtacagacctgtcattccaaagaacatttcctcaagcgtctgagccaagttttcgtaagacgaatgagctctcatatccacttttctgcctataccaactccatccatattcaccttaacaaaccctaagccctgaactttcggattcaccttcattgacacatctttgagctcatcattcttcacaactttcttctccccgtctccttcttccgctcttgctgccttcatagcttggttattaaccaaactgttcatcctgtgtaacccaattggtggccatcctaccacttgactgccacaacaaaccaagaaatttccactcaatggctctcgaaattcagatgtaatcatctaaacagacattaaaatgaacaaatcttagcatttgcatgactccatagagaaatctatagcacaggacaagcacaagctcatcaatggagatagatacctaactcttattcagggtaaactaaaacaaaagcacctacacaattctgtcctgagatggcataacactcacatcacaagatttgagctttcttaataagaaaaaggacgaaccttgaacgaggaggagaagctccttggtgagaggaagattcagcagagcgtttagacccaacggaaggaaaatccttagcagtaagaatcctcccacgctctttccacgcgccaccaccgaggctgagccctaatcccaattccagctcactctccgccggaagattactcttccccacctccaattctgacacaccacgcat

SEQ ID NO: 684 - DNA, 1229 bp, Arabidopsis thaliana; identical to SEQ ID NO: 683
  G464 DNA sequence used for BLAST

SEQ ID NO: 685 - DNA, 998 bp, Arabidopsis thaliana
  G466 cDNA Sequence
tcacaatcaaaatcttaattctcagcttctggttttgtcgaaaatggaaggcggttccgctagtggatcggcttcggctttgtcaaacgatgaaaatctcgtcgtttcttgtgaggattcttcttctcctatagggaatgagcttgagcttggtcttacgttgagccttggtcgcaaagggtatcgagattgtagggtttacgctgatgattcttcttcttcttcatcatcttcttctctgagcagagctagcgtaattgctgggatcaagaggacagctgattccatggctgcaactagtgggcaagttgtgggatggccaccaataaggacttacagaatgaacagtatggttaaccaagctaaggcttcagccactgaagatccgaacttggagataagtcaagccgtaaacaagaatagaagtgattcaacaaagatgagaaattccatgtttgttaaggtgactatggatggcattcctattggaaggaaaatcgatctgaatgctcataaatgctatgaatcattgtcaaacactctagaggaaatgtttctgaaacctaaattaggttcacgcacactagaaaccgatggtcacatggaaacaccggtcaagatactaccagatgggtcttccggattagtactaacgtatgaagacaaggaaggagattggatgcttgttggcgatgttccgtgggggatgtttattggttcagtgagaaggctccggataatgaaaacatcggaggctactggtaaagctcagatgatattatgaagcaaataataatctacgaagaaccctttatgtttgaagcagtaataagacagatcacagatcaaagagaagacaaaaacattgtaagaagcttcttcttcttctctcccctttacagtttcttttttggctctgccatttttcttttagttagttatatgttctctttgtaaatcacactttaaaaatctataagaaaaccctttcttgcaca

SEQ ID NO: 686 - protein, 246 aa, Arabidopsis thaliana
  G466 Amino Acid Sequence
MEGGSASGSASALSNDENLVVSCEDSSSPIGNELELGLTLSLGRKGYRDCRVYADDSSSSSSSSSLSRASVIAGIKRTADSMAATSGQVVGWPPIRTYRMNSMVNQAKASATEDPNLEISQAVNKNRSDSTKMRNSMFVKVTMDGIPIGRKIDLNAHKCYESLSNTLEEMFLKPKLGSRTLETDGHMETPVKILPDGSSGLVLTYEDKEGDWMLVGDVPWGMFIGSVRRLRIMKTSEATGKAQMIL

SEQ ID NO: 687 - DNA, 1468 bp, Arabidopsis thaliana
  G466 DNA sequence used for BLAST
atggaaggcggttccgctagtggatcggcttcggctttgtcaaacgatgaaaatctcgtcgtttcttgtgaggattcttcttctcctatagggaatgagcttgagcttggtcttacgttgagccttggtcgcaaagggtatcgagattgtagggtttacgctgatgattcttcttcttcttcatcatcttcttctctgagcagagctagcgtaattgctgggatcaagaggacagctgattccatggctgcaactagtgggtgagtgaaattctcttccctttcctcttttacattttgatcaattatggtttatttggggattcttaatatcatgattatcaatagaactataaataaagatttgatttttgctttttatggttatgggattgattagacagaatgtccttgatcacagttatctgaaaagattcgacctttgttacgtatagatgactttgaatgtatcttcctgatcattagatagtttgctttggtcattatatcttcaaattgaatcttactatcgttttctagagatgacagtttttttcttcttggattctaaagtatttattagctttggagagaaagtgattaatcctgtatagtgattctcttggtatctgattttacaaggccctgaagtgtttataaccctttttatgtgtttactcttatttgagcaatttgaaacctttgaaaatggcaggcaagttgtgggatggccaccaataaggacttacagaatgaacagtatggttaaccaagctaaggcttcagccactgaagatccgaacttggagataagtcaagccgtaaacaagaatagaagtgattcaacaaagatgagaaattccatgtttgttaaggtgactatggatggcattcctattggaaggaaaatcgatctgaatgctcataaatgctatgaatcattgtcaaacactctagaggaaatgtttctgaaacctaaattaggtgtgcttttcgaatctcatggccttttttttggttcctttgaagttggttcttggtatgggaaatgaagttatgattctttctttaatcaggttcacgcacactagaaaccgatggtcacatggaaacaccggtcaagatactaccagatgggtcttccggattagtactaacgtatgaagacaaggaaggagattggatgcttgttggcgatgttccgtgggggtatgcatacatatgttcttatgcttttgatgctttgtcccgtgtaagcgtcaaattctgaagtttgaacctgagttttacttgtgtctaggatgtttattggttcagtgagaaggctccggataatgaaaacatcggaggctactggtaaaggtacatttactgattcgatcaaatcctgatatctgtattaaaatcattgttttgtcgttgtgaccgtgtttgtgtgatccttgtttacagctcagatgatattatga

SEQ ID NO: 688 - DNA, 1239 bp, Arabidopsis thaliana
  G467 cDNA Sequence
ggttgcttcaagagttttggatagtgtagcagagagattttaactaatgggtttataaaattttgttcttttgcgtgaacaagttgtcaacttctagacagattttctttttgaagtgttttcttgtcgaaattcttcttcttttggtcaaagaacgcaagattcttctgtagttcctctaaaaaaaatcctaatggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaagaactgctcctggtccagttgtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcagctcaaagagactttccatcatccatagaagatgaaaaaccaatcactggattattagatgggaatggagaatatactcttacatatgaagacaatgaaggagacaagatgcttgtaggagatgttccatggcaaatgtttgtgtcttcggtgaagaggctgcgtgtgattaaaacttctgagatttcttcagcattaacatatggaaatggtaagcaagagaaaatgagaagatgaagaaaaagatcttttacagcttttaaagaagtagagagatgttattaattgcattttgcctttaaactttgatgagtttttggtcttggaaaagtttctgatataagtctgatgtacattctggtttgttacatcttcttttggcttttgagatatcatagagttttgttggaactcaaagaccaaacagtgcaatgatgattttggggtcttgagtaaatttacaaacccttttaggcaaa

SEQ ID NO: 689 - protein, 267 aa, Arabidopsis thaliana
  G467 Amino Acid Sequence
MEGYSRNGEISPKLLDLMIPQERRNWFHDEKNSVFKTEEKKLELKLGPPGEEDDDESMIRHMKKEPKDKSILSLAGKYFSPSSTKTTSHKRTAPGPVVGWPPVRSFRKNLASGSSSKLGNDSTTSNGVTLKNQKCDAAAKTTEPKRQGGMFVKINMYGVPIGRKVDLSAHNSYEQLSFTVDKLFRGLLAAQRDFPSSIEDEKPITGLLDGNGEYTLTYEDNEGDKMLVGDVPWQMFVSSVKRLRVIKTSEISSALTYGNGKQEKMRR

SEQ ID NO: 690 - DNA, 1461 bp, Arabidopsis thaliana
  G467 DNA sequence used for BLAST
atggagggttattcaagaaacggtgaaatctctccgaagctgcttgacttgatgattccacaagagagaagaaattggtttcacgatgagaaaaactctgttttcaaaacagaggagaagaagcttgagctaaagcttggaccacctggtgaagaagatgatgatgaatcgatgataagacacatgaagaaagaaccaaaagacaaatctatcctctctctcgctggcaaatacttctctccttcttccaccaaaaccacatcccataaaaggttttaaacttctcatctcttactttttgtttttctctgttttgtatccttctcacatgatgatattcacttgttattagccaataaggtcccatctatctgcataaactttgttcttgtctgcttaagattggatctcaaaacttttcatctttttacccttttcccatctgaaagtttcagtctttttactgccctagttttcctctgtttttaaccttgagattgttcttgtcttactaacaagttttgttttgatgcctttgtgttttaaagaactgctcctggtccagtggtgggatggcctccggttcgatccttcaggaagaatttagctagtggaagttcttcaaagcttggaaatgactcaaccacctccaatggtgttaccctcaagaaccaaaagtgtgatgctgctgctaagacaacagaaccaaagagacaaggaggcatgtttgtgaagatcaacatgtatggtgttcccattggtcgtaaagttgatctcagtgctcataatagctatgagcagttatctttcacagttgacaagctcttcagaggtcttcttgcaggtaaatttgaaacctttgtctctctattgattatggttaaaaaagggttgaattttgaactctaattgttcttattttatcagctcaaagagactttccatcatccatagaagatgaaaaaccaatcactggattattagatgggaatggagaatatactcttacatatgaagacaatgaaggagacaagatgcttgtaggagatgttccatggcagtaagaatcttttcttttctttttcgtttttttctgaatctgagtcagctttttgttctatctaaaggagaagtattagattcctagtcacatatttattatatcttaatcacagtttgattaataacaaacttagtttggttaagctattaaagattgtggactttttgatcactaaaattgattatttcttaaattgtcagaatgtttgtgtcttcggtgaagaggctgcgtgtgattaaaacttctgagatttcttcagcattaacatgtaagtgtaggattttaataacattttttagttgttttggtgactcttttaagtgaagttcttagaatgtttttttgttgttttgaaatttgcagatggaaatggtaagcaagagaaaatgagaagatga

SEQ ID NO: 691 - DNA, 2580 bp, Arabidopsis thaliana; identical to SEQ ID NO: 57
  G470 cDNA Sequence

SEQ ID NO: 692 - protein, 859 aa, Arabidopsis thaliana
  G470 Amino Acid Sequence
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 693 - DNA, 4545 bp, Arabidopsis thaliana
  G470 Genomic Sequence
atgtcaattttttctattgaaaaggctttattaaaaaataagaaaaagtggaggaaagaaaataaaatcgtcacttgtctttggttttgtgaggtcgcagaccctggtcccccggaaatggttacaaccggtaatagccggtatgaaagagggaatggtaaccggtgaatgccggttatccatatgggttagaagtttaccgcggttgaaatgattgaagctgagttttgactacctctggttaagcccattggtcgcctcatacccagaaaaacaaaaggataggaaagacgaagaaataaaaagagagagaatgttagagagacaaactctgagagacaaaacaagagaaaatcgctcgtcgtcggtattcaagcgtctgtgactccgataaagcctagactagcgaggacggcgagagagagagagagagagctttggagttgtcgtatctctaaatcggaggcaatttgaggtgaaattggtggttttatcgtttgattctagggtttatcttctctgatagttttatcgagtaatgtcaaggagctaaactagtggtgattgtgtttgttagtgagataaagacaaaggaaggaatcaagtggactaccgaagcgagttttgagctttttcagagacggatttggagatttcttgttgatatcgtctgcttagaggcttatttggtaccagatgaaacagatctgagcttcggaaggtatggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgcttgtaagtctccgtttcttagggtttcttaagcttggttttggttacagactgacttgatctaatttatcttcttcttcttcgtcttcatagtggaccctgaggctgctctttacagagagctatggcacgcttgtgctggtccgcttgtgacggttcctagacaagacgaccgagtcttctattttcctcaaggacacatcgagcaggtgagatatttcatctatgagttcttgctatttttggctaaatctttgagttaacccctctgtgattcgtacctgttgagatattttctaatgaactttgtcggtttccattgttttatgattaggtggaggcttcgacgaaccaggcggcagaacaacagatgcctctctatgatcttccgtcaaagcttctctgtcgagttattaatgtagatttaaaggtaggtttctttaacttcttggaaaattttggtttctgtgtcttggattgtcagctaacaagagttttgtttatgattttacaggcagaggcagatacagatgaagtttatgcgcagattactcttcttcctgaggctaatgtaagttttgttttctgatttattggtttgagtgttgtagaggtgatcttattcttcaagatgctgaattctatatattttttgttccatacagcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggttggtgtttcatttgcgcttctaactatctattcattggcttatttttcctgaattttgttctaagattgccttcaattcattttttgtttcttccctcaggatatgtctcgacagcctcccactcaagagttagttgcaaaggatttgcatgcaaatgagtggcgattcagacatatattccggggtataggaatctgtaacttttttattttctgtttttctcgagtctgtgtgtcatcaaacttatctggttgttgatgtttgtgataatggaccaggtcaaccacggaggcatttgctacagagtgggtggagtgtgtttgttagctccaaaaggctagttgcaggcgatgcgtttatatttctaaggtttgtggattttagttcattgttttctttagctgtatctgttagtttctataatgtggaatatcttaatcttctacaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggtttgtatttgtattagctcacaaaacagctttcagttttttgagctctttgctttgtatgtctctatatgtctgatgcttggtagtgaatcactctactaaattttcatgcggtgttgttttgtttaatacaggacgagcccatctgagtttattgttccgttcgatcagtatatggagtctgttaagaataactactctattggcatgagattcaaaatgagatttgaaggcgaagaggctcctgagcagaggtaaaacctgtcttctgcttttgaaatatgttagctcttgagcctttttctcttggaataacgaacctaacaagttgtattgatttatattaggtttactggcacaatcgttgggattgaagagtctgatcctactaggtggccaaaatcaaagtggagatccctcaaggtatgacctagtttctagagaggatcaagactattgtttgaatataatgaatgctgattgttcaattgtctttcaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtaatgtcttccccttccactgtagtacacatagtagtgcgtctgaaacttaattgaacttgtcagtgggagtctaattcattgtacacaaaacaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggtaaatttttgcaatatgtagcacaaagtgtatgaggttgtgataacccttgaatcacttttcaactaacacatgacacattgatgtaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcagtaagattttgcaaattttccatcttagtttatatcgatgttagtgtttttcttataacactgacacaatgatctctcttgcagggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 694 - DNA, 4545 bp, Arabidopsis thaliana; identical to SEQ ID NO: 693
  G470 DNA sequence used for BLAST

SEQ ID NO: 695 - DNA, 2124 bp, Arabidopsis thaliana
  G474 cDNA Sequence
ttttttttctccacggcttaaagactcactcatcactgtgctactactctctcttcttttggctgagagggtaaaagtcatgaagaaactcctctgagttttttttctttctttcttataataaagctcttatctttatctctgtttctctctctttaatgggtggtttaatcgatctgaacgtgatggagacggaggaagacgaaacgcaaacgcaaacaccgtcttcagcttctgggtctgtctctcctacttcgtcttcttcagcttctgtgtctgtggtgtcttcgaattctgctggtggaggggtttgtttggagctgtggcatgcttgtgctggaccccttatctctctaccaaaaagaggaagccttgtgttgtatttccctcagggacatttggaacaagcccccgatttctccgccgcgatttacgggctccctcctcacgtgttctgtcgtattctcgatgttaagcttcacgcagagacgactacagatgaagtttatgctcaagtctctcttcttcctgagtcagaggacattgagaggaaggtgcgtgaaggaattatagatgttgatggtggagaggaagattatgaagtgcttaagaggtctaatactcctcacatgttttgcaaaacccttactgcttctgatacaagcacccatggtggtttctctgttcctcgccgagctgctgaggattgcttccctcctctggactatagccagccccggccttctcaggagcttcttgctagggatcttcatggcctggagtggcgatttcgccacatttatcgagggcaacctaggaggcatttgctcactaccgggtggagtgcgtttgtgaacaagaagaagcttgtctctggtgatgctgtgcttttccttagaggagatgatggcaaactgcgactgggagttagaagagcttctcaaatcgaaggcaccgctgctctctcggctcaatataatcagaatatgaaccacaacaatttctctgaagtagctcatgccatatcgacccatagcgttttcagcatttcctacaaccccaaggcaagctggtcaaacttcataatccctgcaccaaagttcttgaaggttgttgactatcccttttgcattgggatgagatttaaagcgagggttgaatctgaagatgcatctgagagaagatcccctgggattataagtggtatcagcgacttggatccaatcaggtggcctggttcaaaatggagatgccttttggtaaggtgggacgacattgtggcaaatgggcatcaacagcgtgtctcgccatgggagatcgaaccatctggttccatctccaattcaggcagcttcgtaacaactggtcccaagagaagcaggattggcttttcctcaggaaagcctgatatccctgtctctgaggggattcgcgccacagactttgaggaatcattgagattccagagggtcttgcaaggtcaagaaatttttccgggttttatcaacacttgttcggatggtggagccggtgccaggagaggccgcttcaaaggaacagaatttggtgactcttatggtttccataaggtcttgcaaggtcaagaaacagttcccgcctactcaataaccgatcatcggcagcagcacgggttgagccagaggaacatttggtgtgggccgttccagaactttagtacacgtatcctccccccatctgtatcatcatcaccctcttccgtcttgtttaccaactcgaacagtcctaacggacgtctggaagaccatcacggaggttcaggcagatgcaggctgtttggtttcccattaaccgacgaaaccacagcagttgcatctgcgacggctgtcccctgcgttgaagggaattccatgaaaggtgcgtcagctgttcaaagcaatcatcatcattcgcaaggaagggacatctatgcaatgagagacatgttgctagacattgctctctagaagggttctttggtttctgtgttttatttgcttgtggcttaagtaaagttcttattttagttgatgatgacttgctgctaacttttggaatgtcacaagttgtgacttatgagagacttgtagacttggttcaaaaaaa

SEQ ID NO: 696 - protein, 608 aa, Arabidopsis thaliana
  G474 Amino Acid Sequence
MGGLIDLNVMETEEDETQTQTPSSASGSVSPTSSSSASVSVVSSNSAGGGVCLELWHACAGPLISLPKRGSLVLYFPQGHLEQAPDFSAAIYGLPPHVFCRILDVKLHAETTTDEVYAQVSLLPESEDIERKVREGIIDVDGGEEDYEVLKRSNTPHMFCKTLTASDTSTHGGFSVPRRAAEDCFPPLDYSQPRPSQELLARDLHGLEWRFRHIYRGQPRRHLLTTGWSAFVNKKKLVSGDAVLFLRGDDGKLRLGVRRASQIEGTAALSAQYNQNMNHNNFSEVAHAISTHSVFSISYNPKASWSNFIIPAPKFLKVVDYPFCIGMRFKARVESEDASERRSPGIISGISDLDPIRWPGSKWRCLLVRWDDIVANGHQQRVSPWEIEPSGSISNSGSFVTTGPKRSRIGFSSGKPDIPVSEGIRATDFEESLRFQRVLQGQEIFPGFINTCSDGGAGARRGRFKGTEFGDSYGFHKVLQGQETVPAYSITDHRQQHGLSQRNIWCGPFQNFSTRILPPSVSSSPSSVLFTNSNSPNGRLEDHHGGSGRCRLFGFPLTDETTAVASATAVPCVEGNSMKGASAVQSNHHHSQGRDIYAMRDMLLDIAL

SEQ ID NO: 697 - DNA, 3170 bp, Arabidopsis thaliana
  G474 Genomic Sequence
ctagagagcaatgtctagcaacatgtctctcattgcatagatgtcccttccttgcgaatgatgatgattgctttgaacagctgacgcacctttcatggaattcccttcaacgcaggggacagccgtcgcagatgcaactgctgtggtttcgtcggttaatgggaaaccaaacagcctgcatctgcctgaacctccgtgatggtcttccagacgtccgttaggactgttcgagttggtaagcaagacggaagagggtgatgatgatacagatggggggaggatacgtgtactaaagttctggaacggcccacaccaaatgttcctctggctcaacccgtgctgctgccgatgatcggttattgagtaggcgggaactgtttcttgaccttgcaagaccttatggaaaccataagagtcaccaaattctgttcctttgaagcggcctctcctggcaccggctccaccatccgaacaagtgttgataaaacccggaaaaatttcttgaccttgcaagaccctctggaatctcaatgattcctcaaagtctgtggcgcgaatcccctctgcaataatagcagaaaacgttatattacaggcgataaatggttatatgagtggtacaatgtctttggctaagtagatgtgtaccagagacagggatatcaggctttcctgaggaaaagccaatcctgcttctcttgggaccagttgttacgaagctgcctgaattggagatggaaccagatggttcgatctcccatggcgagacacgctgttgatgcccatttgccacaatgtcgtcccaccttacctgaatatgacgtcaaaacatagtttcagagcagtgagcttacggatatagaaaaggcaacaatcttatagaagacctctcagaccaaactaatgacttaagaacataattcatagcttaccaaaaggcatctccattttgaaccaggccacctgattggatccaagtcgctgataccacttataatcccaggggatctgacaaaacaggtgaaacatgttagaaagttgggcatataaaacacaggtgtgcaaggttatcttaaagcttgaattataagtctataagtaaccttctctcagatgcatcttcagattcaaccctcgctttaaatctcatcccaatgcaaaagggatagtcaacaaccttcaagaactttggtgcagggattatgaagtttgaccagcttgccctgaaaatgttttaccagtgaactagtattaatgctaaattcctgatatttattggagttaacaaacttctaaggaacaatcaactagaacaatacacaacttaaggcttcaggagattctaattatgattctgaaatgaaattttaaatgctgaaaacgaaaaaaggtcattgtggttggggcttacttggggttgtaggaaatgctgaaaacgctatgggtcgatatggcatgagctacttcagagaaattgttgtggttcatattctgattatattgagccgagagagcagcggtgccttcgatttgagaagctcttctaactcccagtcgcagtttgccatcatctcctctgtatcagagaaacccatatatcacaaaacctcttacagaaaatcaaagaggttgtgtagtgagaaaacatagaagcatttttaactacctaaggaaaagcacagcatcaccagagacaagcttcttcttgttcacaaacgcactccacccggtagtgagcaaatgcctcctaggttgccctaaaagtcactcaaaccattcaaattttccatctactaaatccaggcaagaaaaattgcaacataaggcaacaaacttacctcgataaatgtggcgaaatcgccactccaggccatgaagatccctagcaagaagctcctgagaaggccggggctggctatagtcctacataacaaaatgattatgtagttaaaatctctcaatatgagctaataagagaactctagaacacaatgtgcaatgtacaaagctgattacagaatctacagagagtggattagtaccagaggagggaagcaatcctcagcagctcggcgaggaacagagaaaccaccatgggtgcttgtatcagaagcagtaagggttttgcaaaacatgtgaggagtattagacctcttaagcacttcataatcttcctctccaccatcaacatctataattccttcacgcaccttcctctcaatgtcctgtaacaaatcaactcaaaccccctaagctcgagcaaatttctctctctttgttacaaaactcaagagcctaaagaaaaactcacctctgactcaggaagaagagagacttgagcataaacttcatctgtagtcgtctctgcctacgaaatcaaaatcccccacattttgtttattaatcctcacaacaacaaaaaaagtttaaacctttacagagaattgaattgttctgaaatcaattgtcatcaaaatggagcaaaaggcgaaactttgaaatcaaattcattatcatcaaagaaaaaactgaagataatttatggggatttcaagtattcgtcatcaaaatgccacgagaagaaatgcaaatggagcaaaagaggaaacttttctcccaacataaattcgtttgtctcaaacaattcaataaaccaaaggcacaaatctccatacttgtatcgaaaacccaactcagattcaccaaacaaacaattaaaaaaatcaaagaatcagaaaaacagaacaaaacccatatctctctgctttgagagcagaggagaaaacataaatgaagaaaacaaaacaaaacaaaaaatagaaagaaagagagagttagttacatacgtgaagcttaacatcgagaatacgacagaacacgtgaggagggagcccgtaaatcgcggcggagaaatcgggggcttgttccaaatgtccctgagggaaatacaacacaaggcttcctctttttggtagagagataaggggtccagcacaagcatgccacagctccaaacaaacccctccaccagcagaattcgaagacaccacagacacagaagctgaagaagacgaagtaggagagacagacccagaagctgaagacggtgtttgcgtttgcgtttcgtcttcctccgtctccatcacgttcagatcgattaaaccacccat

SEQ ID NO: 698 - DNA, 3170 bp, Arabidopsis thaliana; identical to SEQ ID NO: 697
  G474 DNA sequence used for BLAST

SEQ ID NO: 699 - DNA, 624 bp, Arabidopsis thaliana
  G475 cDNA Sequence
gagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacaggctttgcttactctcttctgtcagtctcttttagctccttgtaatcctctgtgtctctgtctgtttctccatattacctgtaatcaaagctatctgctaaacctacgacatggttaaataaatgcattgagacttagtaaaaaaaaaaaaaaaaaaaa

SEQ ID NO: 700 - protein, 131 aa, Arabidopsis thaliana
  G475 Amino Acid Sequence
MSMRRSKAEGKRSLRELSEEEEEEEETEDEDTFEEEEALEKKQKGKATSSSGVCQVESCTADMSKAKQYHKRHKVCQFHAKAPHVRISGLHQRFCQQCSRFHALSEFDEAKRSCRRRLAGHNERRRKSTTD

SEQ ID NO: 701 - DNA, 408 bp, Arabidopsis thaliana
  G475 Genomic Sequence
atgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtaaatttttgtcatcttttttcaaaactcctgcaacaataaccataaacaagaacaagaaatatgagaccttttaccttttgtttttaaggtttcacgcgctcagtga

SEQ ID NO: 702 - DNA, 481 bp, Arabidopsis thaliana
  G475 DNA sequence used for BLAST
atgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtaaatttttgtcatcttttttcaaaactcctgcaacaataaccataaacaagaacaagaaatatgagaccttttaccttttgtttttaaggtttcacgcgctcagtgagtttgatgaagccaagcggagttgcaggagacgcttagctggacacaacgagagaaggcggaaaagcacaactgactaa

SEQ ID NO: 703 - DNA, 832 bp, Arabidopsis thaliana
  G481 cDNA Sequence
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 704 - protein, 141 aa, Arabidopsis thaliana
  G481 Amino Acid Sequence
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 705 - DNA, 1487 bp, Arabidopsis thaliana
  G481 Genomic Sequence
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgagtatgcattcccaatttttcttctttcaatcgaatttgttggaaaatattttgctctttggtgaaaaaaattgatcatttgttggaactttgggtttgtgagagatagttttcttaaactagctatggattgagtttagctcagagagttttttgaagtttatagagcaaagattatgtttttttttttgtcacaatgttaatcaaccattgtttggtatgggtttaccttaacctagttcctttcctatagaccattttgcagattatttcacatgcttctactgtgttatatcttaactctgtcaaataaattgttagatttttttcttcatttaaccatcttagggtataaaagccgtatcttgatcatgtttcaaagattcttttatctttaggatctgtttgtttttgttcctttttgttcatttaaggcaaaagatatgtttttcatcatgaaggaattgcttgtgttgaatgcgttttaggtctctgattgatgagttttatgtttcttataacatcagatgcccccgttctttgttaggaagaaataagttatcatgtatgaaactatgatttatctattggttcaagataagcttgtctgatgttgcgcttaagtctcttttgctggtcttatgttgattcgttgactgtaatggccaattgactggtatctgtttctgctaatcagggccagtgataagtgtcaaaaagagaaaaggaaaactgtgaatggtgatgatttgttgtgggcaatggcaacattaggatttgaggattacctggaacctctaaagatatacctagcgaggtacagggaggtatgttgctttgactccctaatcatgtgttctgaaatccttaatatcctagtcaagagattagtagctgtgagtaacatcgaagcttgccatgatagcagttttacaatcccttcaatacgtcttgtgtagaatttttgaagcaagaaagataaatctagaccaacagtcaggatgcatattagtaaattttgaaagacatttattactctctcttttgtgcttttgttgttaacatacataataaaatcaaaatgtttcttattaagttgagactaattcggttcttttcattccctgggactactttatattccattccagtgttgcccattggcttcttacgttttgttgtgaaattatgatagggtgataataagggatcaggaaagagtggagatggatcaaatagagatgctggtggcggtgtttctggtgaagaaatgccggtatgattttga

SEQ ID NO: 706 - DNA, 1541 bp, Arabidopsis thaliana
  G481 DNA sequence used for BLAST
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgagtatgcattcccaatttttcttctttcaatcgaatttgttggaaaatattttgctctttggtgaaaaaaattgatcatttgttggaactttgggtttgtgagagatagttttcttaaactagctatggattgagtttagctcagagagttttttgaagtttatagagcaaagattatgtttttttttttgtcacaatgttaatcaaccattgtttggtatgggtttaccttaacctagttcctttcctatagaccattttgcagattatttcacatgcttctactgtgttatatcttaactctgtcaaataaattgttagatttttttcttcatttaaccatcttagggtataaaagccgtatcttgatcatgtttcaaagattcttttatctttaggatctgtttgtttttgttcctttttgttcatttaaggcaaaagatatgtttttcatcatgaaggaattgcttgtgttgaatgcgttttaggtctctgattgatgagttttatgtttcttataacatcagatgcccccgttctttgttaggaagaaataagttatcatgtatgaaactatgatttatctattggttcaagataagcttgtctgatgttgcgcttaagtctcttttgctggtcttatgttgattcgttgactgtaatggccaattgactggtatctgtttctgctaatcagggccagtgataagtgtcaaaaagagaaaaggaaaactgtgaatggtgatgatttgttgtgggcaatggcaacattaggatttgaggattacctggaacctctaaagatatacctagcgaggtacagggaggtatgttgctttgactccctaatcatgtgttctgaaatccttaatatcctagtcaagagattagtagctgtgagtaacatcgaagcttgccatgatagcagttttacaatcccttcaatacgtcttgtgtagaatttttgaagcaagaaagataaatctagaccaacagtcaggatgcatattagtaaattttgaaagacatttattactctctcttttgtgcttttgttgttaacatacataataaaatcaaaatgtttcttattaagttgagactaattcggttcttttcattccctgggattggttgctgacacaccacctgctgatgcagttggaggtaaataaaccacatacttatttctactttatattccattccagtgttgcccattggcttcttacgttttgttgtgaaattatgatagggtgataataagggatcaggaaagagtggagatggatcaaatagagatgctggtggcggtgtttctggtgaagaaatgccggtatga

SEQ ID NO: 707 - DNA, 1065 bp, Arabidopsis thaliana; identical to SEQ ID NO: 25
  G482 cDNA Sequence

SEQ ID NO: 708 - protein, 190 aa, Arabidopsis thaliana
  G482 Amino Acid Sequence
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 709 - DNA, 573 bp, Arabidopsis thaliana
  G482 Genomic Sequence
atgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaa

SEQ ID NO: 710 - DNA, 573 bp, Arabidopsis thaliana; identical to SEQ ID NO: 709
  G482 DNA sequence used for BLAST

SEQ ID NO: 711 - DNA, 584 bp, Arabidopsis thaliana
  G483 cDNA Sequence
tgggctaaccaaatgcaagagatcgagcataccactgatttcaagaaccacacccttcccctagcccgcatcaagaagatcatgaaagctgatgaagatgtgaggatgatctctgcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagtaacaccctgatgagtcttaaaacttttcccctttcgtttgtttggttgtatcgtagtaaggtagctctgctctgctgggaaccatttctattgtgttctgtaatgacatgttagtatatccccagtctatatctatggcaatgcagtttctgttaaaaaaaaaaaaaaaaaaaaaaaa

SEQ ID NO: 712 - protein, 131 aa, Arabidopsis thaliana
  G483 Amino Acid Sequence
MQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQE

SEQ ID NO: 713 - DNA, 390 bp, Arabidopsis thaliana
  G483 DNA sequence used for BLAST
ctggggccagtgttgcatcatcccctgttgttgcaagtaatagtatggcggggaacccaccaccgatggtatggtccctttggtcacgcctaaaccttcttctttcagctcgtccctcgggattatgtccacaaggaaatcaaacacgtcggtcctggaaatggcagcggcgatgtcgttcttctgcaaggtcctcctcttgttctcctcggtgtggatccaagcacgtagagtgagctccaaaatgaacatctcacaggccttggcaaaaatcacaggagcctccgcagagatcatcctcacatcttcatcagctttcatgatcttcttgatgcgggctaggggaagggtgtggttcttgaaatcagtggtatgctcgatctcttgcat

SEQ ID NO: 714 - DNA, 922 bp, Arabidopsis thaliana
  G484 cDNA Sequence
attatattccgtacaatccgatcgatttcccggcgccagatctcaccgcgactcgtctactttccgatttggttcgtgttgactcagttacgattaaactatggatccaatggatatagtcggcaaatccaaggaagacgcttctcttccaaaagctacgatgactaaaattataaaggagatgttaccaccagatgttcgtgttgcaagagatgctcaagatcttctcattgaatgttgtgtagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatgcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaactgaaaccgtaagggtaagtgttaggcaagaaaaaacaacatccttttaacattcccttgtaagttgcaaatgcgtatgttctctgtttatatgctcttagtatgatatatgttagttagtgtttcacgatctaaaaacacttgtgattcagatgtaattagtaagcattccttgttttgtgtttactttgtgtcttgactaagcatggtgggtcaggtctacacaaagcatctgattcgatgacttacaggaatcttaatgtttgtagattggataaatttggtgattggtgtaattgtttttccataaacacaatgcaatcattgtttagtgttgttaac

SEQ ID NO: 715 - protein, 159 aa, Arabidopsis thaliana
  G484 Amino Acid Sequence
MDPMDIVGKSKEDASLPKATMTKIIKEMLPPDVRVARDAQDLLIECCVEFINLVSSESNDVCNKEDKRTIAPEHVLKALQVLGFGEYIEEVYAAYEQHKYETMQDTQRSVKWNPGAQMTEEEAAAEQQRMFAEARARMNGGVSVPQPEHPETDQRSPQS

SEQ ID NO: 716 - DNA, 813 bp, Arabidopsis thaliana
  G484 Genomic Sequence
atggatccaatggatatagtcggcaaatccaaggaagacgcttctcttccaaaaggttagtgttattgctcattgatcattaaataggaggatttgtaaacctagctatatataactctgcttgaaggttataggattcatgagcatcataaacttcatttttttattatcttgctaagaatatgttttgttgttctctattgttttagctacgatgactaaaattataaaggagatgttaccaccagatgttcgtgttgcaagagatgctcaagatcttctcattgaatgttgtgtaggtaagatcatatagtttctctctgagttcatctatatatgtgagagttcttggttttcttactgtggtttaaaacattttttgcagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatggtaatgattctctactttcttctcctactcttgataacgaggagacgaaaaaacgattaatgttaaccgtttcctacatttgtgactctatagcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaa

SEQ ID NO: 717 - DNA, 813 bp, Arabidopsis thaliana; identical to SEQ ID NO: 716
  G484 DNA sequence used for BLAST

SEQ ID NO: 718 - DNA, 486 bp, Arabidopsis thaliana
  G485 cDNA Sequence
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 719 - protein, 161 aa, Arabidopsis thaliana
  G485 Amino Acid Sequence
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 720 - DNA, 486 bp, Arabidopsis thaliana; identical to SEQ ID NO: 718
  G485 Genomic Sequence

SEQ ID NO: 721 - DNA, 486 bp, Arabidopsis thaliana; identical to SEQ ID NO: 718
  G485 DNA sequence used for BLAST

SEQ ID NO: 722 - DNA, 420 bp, Arabidopsis thaliana; identical to SEQ ID NO: 94
  G486 cDNA Sequence

SEQ ID NO: 723 - protein, 139 aa, Arabidopsis thaliana
  G486 Amino Acid Sequence
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 724 - DNA, 420 bp, Arabidopsis thaliana; identical to SEQ ID NO: 94
  G486 Genomic Sequence

SEQ ID NO: 725 - DNA, 420 bp, Arabidopsis thaliana; identical to SEQ ID NO: 94
  G486 DNA sequence used for BLAST

SEQ ID NO: 726 - DNA, 1171 bp, Arabidopsis thaliana
  misc_feature (1039)..(1039): n is a, c, g, or t
  misc_feature (1148)..(1148): n is a, c, g, or t
  misc_feature (1169)..(1169): n is a, c, g, or t
  G489 cDNA Sequence
tggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttcgcggccgctctagacaggcctcgtaccggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtccatttgttgtgcttgtaatttactgtgttttttattcggttttcgctatcgaactgtgaaatggaaatggatggagaagagttaatgaatgatatggccttttgttcattctcaaattaatattatttggtttttctcttatttgtggggntgaatttgaaattataagagatatgcaaacattttgtttgagtaaaatgtgcaaatcgtggcctctaatgacccgaagttaatatgaggagtaaaacacttgtaggtgnaccattatgcttattcactangc

SEQ ID NO: 727 - protein, 220 aa, Arabidopsis thaliana
  G489 Amino Acid Sequence
MNYGTNPYQTNPMSTTAATVAGGAAQPGQLAFHQIHQQQQQQQLAQQLQAFWENQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 728 - DNA, 627 bp, Arabidopsis thaliana
  G489 Genomic Sequence
ctaattttcctggtcaggttggtcaggtgcctgttgttgccacattggttgacccatataaggattaggtggatacgcaccaccgggattacccataaccattcccggatttcctattggagcagttcctgcaggcaagtatccatacgggtaaccagcagcagcagcttccgggacagtgcccctcggaatacttcccaagacttcatctcggagatcctcccggggaacaatatccacaaggaaatcaaaaatatcggttctagtcacagcagcagcaatatcgttcttctgcaacgtccgcctcttattctcctcagtgtggttccacgacctgagtgtcagctccaggatgaacatctcacaggcccttgcaaacacgacaggcgcctcagccgagatcatacggacatcttcatccgctttcatgattttcttgattctcgcaaggggaaggctgtggttcttgaaatcggtagtcttctcaatctctttgaattggttctcccaaaatgcttgaagctgctgtgccagctgttgctgctgctgctgctgatggatctggtggaacgccagctggcctggttgtgccgcacctcctgctacagtagcagcagtggtgctcat

SEQ ID NO: 729 - DNA, 627 bp, Arabidopsis thaliana; identical to SEQ ID NO: 728
  G489 DNA sequence used for BLAST

SEQ ID NO: 730 - DNA, 1346 bp, Arabidopsis thaliana
  G501 cDNA Sequence
cttacgggtccctatccttcgcaagacccttcctctatataaggaagttcttttcatttggagaggtcacgctgacaagctgactctagcagatctggtaccgtcgacccacgcgtccgaaaaaatccagatccagctgaaattgaattttcaaccaacgaagaagagatttttccaagagcaacagacaagaagaagagaatgaagtcggagctaaatttaccagctgggttccgattccatccaacggacgaggagcttgtgaaattctacttgtgccggaaatgtgcttccgagcagatctcggctccggttatcgccgagattgatctctacaagttcaatccttgggagcttccagagatgtctctgtacggagagaaagagtggtacttcttctcacctagagatcggaaatacccaaacggttcgcgtcctaaccgggcagcaggaaccggttattggaaagctaccggagcagataaaccgattggtaaaccgaagacgttgggtatcaagaaagcactcgtcttctacgcagggaaagctccaaaagggattaagaccaattggataatgcatgagtatcgtctcgctaatgttgatagatcagcttctgttaacaaaaagaacaacctacgacttgatgattgggttttatgtcgaatatacaacaagaaaggaaccatggagaagtatttccccgcggatgagaagccgaggaccacgacaatggctgaacagtcatcatcaccttttgatacatcagactcgacttacccgacattgcaagaggatgattccagcagctcaggtggtcacggtcacgtggtgtcaccggatgttttggaggttcagagcgagcctaaatggggagagcttgaggatgctttggaagcttttgatacttcaatgtttggtagttccatggagttgttgcagcctgacgcttttgtccctcagttcttgtatcagtctgattatttcacttccttccaggatccgcctgagcagaaaccattcttgaattggagttttgctccacaggggtaaaaacggaagagaccaaaaaaggtgtttgctagtagtactgtgatgtgccagagagaagagtctcatctcaactcatccctggctcttagtagtaaaagaagattgtagaatgttaatagcttttagcatcaatgtctcattagcaggcacattcttgttctttcatgagaagtttatatgaaaactaaaaatttatattcaaattcttcaagatgttgcacttatgtagatactgatattaaataacaacctaacctttatgagaaaaaaaaaaaaaaaaaaaaaaaaaaaaa

SEQ ID NO: 731 - protein, 283 aa, Arabidopsis thaliana
  G501 Amino Acid Sequence
MKSELNLPAGFRFHPTDEELVKFYLCRKCASEQISAPVIAEIDLYKFNPWELPEMSLYGEKEWYFFSPRDRKYPNGSRPNRAAGTGYWKATGADKPIGKPKTLGIKKALVFYAGKAPKGIKTNWIMHEYRLANVDRSASVNKKNNLRLDDWVLCRIYNKKGTMEKYFPADEKPRTTTMAEQSSSPFDTSDSTYPTLQEDDSSSSGGHGHVVSPDVLEVQSEPKWGELEDALEAFDTSMFGSSMELLQPDAFVPQFLYQSDYFTSFQDPPEQKPFLNWSFAPQG

SEQ ID NO: 732 - DNA, 990 bp, Arabidopsis thaliana
  G501 DNA sequence used for BLAST
ggccgcatcattcagactatgagggctacggccatcttctagagtcctcaagctcccaaagcatcctcaagctctccccatttaggctcgctctgaacctccaaaacatccggtgacaccacgtgaccgtgaccacctgagctgctggaatcatcctcttgcaatgtcgggtaagtcgagtctgatgtatcaaaaggtgatgatgactgttcagccattgtcgtggtcctcggcttctcatccgcggggaaatacttctccatggttcctttcttgttgtatattcgacataaaacccaatcatcaagctgtacagcaaaacccaccacaacaaagttaataatctaaatcatcattcacgaaaagatgatacataagttaataagaaacagaacttactcgtaggttgttctttttgttaacagaagctgatctatcaacattagcgagacgatactcatgcattatccaattggtcttaatcccttttggagctttccctgcgtagaagacgagtgctttcttgatacccaacgtcttcggtttaccaatcggtttatctgctccggtagctttccaataaccggttcctgctgcccggttaggacgcgaaccgtttgggtatttccgatctctaggtgagaagaagtaccactctttctctccgtacagagacatctctgaaagaagaacaaacatctcaataaacaacgattctcgaagacacatgatttcgcgaaaaataattagaagaagcccataggtgtacctggaagctcccaaggattgaacttgtagagatcaatctcggcgataaccggagccgagatctgctcggaagcacatttccggcacaagtagaatttcacaagctcctcgtccgttggatggaatcggaacccagctggtaaatttagctccgacttcattctcttcttcttgtctgttgctcttggaaaaatctcttcttcgttggttgaaaattcaatt

SEQ ID NO: 733 - DNA, 1409 bp, Arabidopsis thaliana; identical to SEQ ID NO: 26
  G502 cDNA Sequence

SEQ ID NO: 734 - protein, 289 aa, Arabidopsis thaliana
  G502 Amino Acid Sequence
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 735 - DNA, 1137 bp, Arabidopsis thaliana
  G502 Genomic Sequence
atgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtgacatactagctctctttctctttaatctttgccggattctaaatctgagattgttctctgctgactcaaattcaattttacaggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcagggtatggaatcagatctgattcacatctttgtttcaatctcttgttctgtttctggtaaattgaatcaacggtgttgatttttgcccagctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatga

SEQ ID NO: 736 - DNA, 1137 bp, Arabidopsis thaliana; identical to SEQ ID NO: 735
  G502 DNA sequence used for BLAST

SEQ ID NO: 737 - DNA, 914 bp, Arabidopsis thaliana
  G503 cDNA Sequence
gaacatcaaaaactaacacacagaaagaaaaaaaacagttcctgttccattagattcttttctaaattgtctgaaaatcatggaagtaacttcccaatctaccctccctccagggttccgatttcatcctaccgacgaagaactcatcgtttactatctccgaaaccagaccatgtctaaaccatgccctgtctccatcatcccagaagttgatatctacaaattcgacccatggcaattacccgagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcgagtaacgtaggtgtcaagaaagctctcgtcttctacaaaggtagacctcctaaaggaatcaaaactgactggatcatgcatgagtatcgtctccatgattcacgtaaagcatcaacgaaacgtagcggatctatgaggttagatgaatgggtactatgtaggatatacaagaagagaggagcaagtaagcttctgaatgagcaagagggtttcatggacgaagtactaatggaggatgagaccaaagttgttattaacgaagcagagagaagaaatgatgaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggatctacagtttaaccaagacgagatcttaaaccatcatcgtcaagctatgtttaagttttagtgatggggtcagtaaaaaaaaaaaaaaa

SEQ ID NO: 738 - protein, 268 aa, Arabidopsis thaliana
  G503 Amino Acid Sequence
MEVTSQSTLPPGFRFHPTDEELIVYYLRNQTMSKPCPVSIIPEVDIYKFDPWQLPEKTEFGENEWYFFSPRERKYPNGVRPNRAAVSGYWKATGTDKAIHSGSSNVGVKKALVFYKGRPPKGIKTDWIMHEYRLHDSRKASTKRSGSMRLDEWVLCRIYKKRGASKLLNEQEGFMDEVLMEDETKVVINEAERRNDEEIMMMTSMKLPRTCSLAHLLEMDYMGPVSHIDNFSQFDHLHQPDSESSWFGDLQFNQDEILNHHRQAMFKF

SEQ ID NO: 739 - DNA, 2427 bp, Arabidopsis thaliana
  G503 Genomic Sequence
atcagtattattatatatgcagtataaagttattgatgtgtatattttgtcatgcaaactatatcgtggagaaaataatgttgcttatgacttttgatagtttgggcttacatttggataatggatagggtagacaaagataggaggaaagcaataatagcgaaatgaagaacgaatatttggggaaataggacaaatgaatatacttctctttgaaatggagattcacctaaattattaatactaaagccatgcaatgcgtccaaacaaatcagtggtcaagcacactcaattatatgtccacgaagacctttagaatcttcacaaccaaaggccattttctacgctacctgataattctgacttaattcttgttcataaaacgtataatgaagctttatgaatgattaattatagacacaaccggccctatctgcgatttctacaaacaatagaacacaaaactttaaaagttactacaaaataccgaattgactatatatatcatattatcagtataaacatgattagattgatcatgtttatcagtaatcatgaaagacaaagattgtgactattgtaaaccaaattttagaataaaataaataatttatcatactatatacagtattttgttaagtatatgtcatccaatagtaacattatcatttaaactgaaaaatgtttcagctactttaaggaattatagctttattaaaagtatatacttttaggtcacgtgtttagaggtgaagaacaataataattactcaataagttcaccagtcacactccaacatcttattcaaattccttttaaaagctttttaaccgtggctgtttgatgaccatttgacaaaatttagtatattagaaaaaaacaataggatagggataatataggacattagactattagaaggacaaaatgaagtattatttaattttccaatgtaccaaccaataagaaagaagtgacgcacagtaaacgacaaaaagctcaagcataaaaacccaaaccttctctgctttctaaacatttcaagaaccttgagaacatcaaaaactaacacagaaagaaaaaaaacagttcctgttctattagattgttttctaaattgtctgaaaatcatggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccggttagacccggtttatctctcaatgataacctattcttctagatgttcatgtttagagctactttccttatttgctttgttcgttttgtatttacagagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagccctagtcttctacaaaggtagacctcctaaaggaatcaaaactgactggatcatgcatgagtatcgtctccatgattcacgtaaagcatcaacgaaacgtaacggttccatgagggtacgtaagcagaggaaacaagtttatagctcttgtatattttattacaacttgtgaaaatgttaattttctttatatttttgcagttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagcgatgtttaagttttagtgatggggtcagtaaaaaagaagaagaaacaagaaaagatgtgcttgaaaagttactttggtagatatttggttagtttgggtacatgaatgaaaattgtaaaatattataactaaaacccaatgggattttatatttctcccatatgaatgtgaaatgaaaaacaatgtttaattaaaaattaagttgtttcagcatgataagacgaagtcacgaagttgatttacattacgaactaataaaacaaaagacttttgtaacttacgatgtttttaaaatgataaaaagagagattgagattacgtt

SEQ ID NO: 740 - DNA, 990 bp, Arabidopsis thaliana
  G503 DNA sequence used for BLAST
atggaagtaacttcccaatctaccctccctccagggttcagatttcatcctaccgacgaagaactcatcgtttactatcttcgaaaccagaccatgtctaaaccatgccctgtctccatcatcccagaagttgatatctacaaattcgacccatggcaattacccggttagacccggtttatctctcaatgataacctattcttctagatgttcatgtttagagctactttccttatttgctttgttcgttttgtatttacagagaaaacagagtttggagaaaatgagtggtatttcttcagccctagagaaagaaaatatccaaacggagtcagaccaaaccgggcagctgtttccggttattggaaagcaaccggtacagacaaagccattcacagcggttcaagtaacgtaggtgtcaagaaagctctagtcttctacaaaggtagacctcctaaaggaatcaaaactgactggatcatgcatgagtatcgtctccatgattcacgtaaagcatcaacgaaacgtaacggttccatgagggtacgtaagcagaggaaacaagtttatagctcttgtatattttattacaacttgtgaaaatgttaattttctttatatttttgcagttagatgaatgggtactgtgtaggatatacaagaagagaggagcaagtaagcttctgaatgagcaagagggtttcatggacgaagtactaatggaggatgagacaaaagttgtagttaacgaagcagagagaagaactgaagaagagataatgatgatgacgtcgatgaaacttccaaggacgtgttcgctggctcatttgttggaaatggattacatgggacccgtctctcacattgataattttagtcagttcgatcatcttcatcaacctgattcggagtctagttggttcggggaccttcagtttaaccaagacgagatcttaaaccatcatcgtcaagcgatgtttaagttttag

SEQ ID NO: 741 - protein, 375 aa, Arabidopsis thaliana [sequence omitted]

SEQ ID NO: 742 - DNA, 1830 bp, Arabidopsis thaliana
  G505 Genomic Sequence
atggacattccgtattaccactacgaccatggcggagacagccaatatcttccaccgggtttcaggtttcatcccacggacgaagagctcatcactcattaccttctccgcaaagtcctcgacggttgcttctcaagccgtgccatcgcagaagttgatctcaacaagtgtgagccttggcaacttcccggtaagaaaatacaaaactaacttacttgtagttcttttgtaattaaggtttctgaaatctttactctcaatgttacttagggagagctaagatgggagagaaagaatggtacttctttagcctccgtgaccggaagtatccgacgggactgagaactaacagagcaactgaggctggttactggaaagctaccggaaaagacagagagatctttagttcaaagacttgtgcacttgttgggatgaagaagactcttgtcttttacaaaggaagagctccgaaaggagagaagagtaattgggttatgcatgaatatcgtcttgaaggcaaattctcttaccatttcatctcaagaagctccaaggtacttcgatttaacctttcattagttattttgttgataaagtaaagccttaattttctttgattaataaatttacaatctattatttggaaaaaaaattcgagagtgtgacatagtcggtgacgttgatttttttctcttttgctttattgcatttaattttgatggctgaaaaggcatggttctttactgtggttatctgagagcattatggaacatgaaatagaaaagatctgctgtttttatgtattgggatttcaatcataatggtgttttcctaaagtaagaaaacattcaatagctctgataaaataaaatattaatacatcctacttttggaaagcttaatgcaaaaaaccagaaccaatgcaaatcttcaggatttttttctgacctagatatattaaaaagaaatttaattaaattaattttacttaattagtgttccatatccattgtagacttgtagtgtccaatgtacattccctctgtgcacgcttttactctatggtttttcttaatcttcactctcttttatttccaagatctaacattgactttctcatcaaacatatattatataaaatatttgacttttcaaaactctaatttattccttcaggatgaatgggtgatctctagggttttccagaaaaccactttagctagcaccggagccgtctccgaaggaggaggaggaggaggagcaactgtgagcgtaagcagcggtactggtccatctaaaaagacgaaagtaccctcaacaatctcaagaaactatcaagaacaaccaagctctccttcctccgtctcactcccacctctcctggatccgaccactaccctcggctacaccgacagcagttgctcctacgacagccgtagcaccaacacaaccgtcacagccagcgcaataaccgagcacgtgtcctgtttctccactgtccctactactactacggccttgggcttagacgttaactcattcagccgtcttccaccgccgctagggtttgactttgacccttttcctcgtttcgtttctagaaacgtctcgactcaatctaacttcagatcgttccaagaaaacttcaatcaatttccttactttggatcgtcttctgcatcgactatgacctccgccgttaatctgccttctttccaaggcggcggaggcgtctccgggatgaattactggctaccggcgactgccgaagagaatgagtcaaaggtcggtgtgcttcatgctggacttgactgtatttggaactactga

SEQ ID NO: 743 - DNA, 1830 bp, Arabidopsis thaliana
  G505 DNA sequence used for BLAST
tcagtagttccaaatacagtcaagtccagcatgaagcacaccgacctttgactcattctcttcggcagtcgccggtagccagtaattcatcccggagacgcctccgccgccttggaaagaaggcagattaacggcggaggtcatagtcgatgcagaagacgatccaaagtaaggaaattgattgaagttttcttggaacgatctgaagttagattgagtcgagacgtttctagaaacgaaacgaggaaaagggtcaaagtcaaaccctagcggcggtggaagacggctgaatgagttaacgtctaagcccaaggccgtagtagtagtagggacagtggagaaacaggacacgtgctcggttattgcgctggctgtgacggttgtgttggtgctacggctgtcgtaggagcaactgctgtcggtgtagccgagggtagtggtcggatccaggagaggtgggagtgagacggaggaaggagagcttggttgttcttgatagtttcttgagattgttgagggtactttcgtctttttagatggaccagtaccgctgcttacgctcacagttgctcctcctcctcctcctccttcggagacggctccggtgctagctaaagtggttttctggaaaaccctagagatcacccattcatcctgaaggaataaattagagttttgaaaagtcaaatattttatataatatatgtttgatgagaaagtcaatgttagatcttggaaataaaagagagtgaagattaagaaaaaccatagagtaaaagcgtgcacagagggaatgtacattggacactacaagtctacaatggatatggaacactaattaagtaaaattaatttaattaaatttctttttaatatatctaggtcagaaaaaaatcctgaagatttgcattggttctggttttttgcattaagctttccaaaagtaggatgtattaatattttattttatcagagctattgaatgttttcttactttaggaaaacaccattatgattgaaatcccaatacataaaaacagcagatcttttctatttcatgttccataatgctctcagataaccacagtaaagaaccatgccttttcagccatcaaaattaaatgcaataaagcaaaagagaaaaaaatcaacgtcaccgactatgtcacactctcgaattttttttccaaataatagattgtaaatttattaatcaaagaaaattaaggctttactttatcaacaaaataactaatgaaaggttaaatcgaagtaccttggagcttcttgagatgaaatggtaagagaatttgccttcaagacgatattcatgcataacccaattactcttctctcctttcggagctcttcctttgtaaaagacaagagtcttcttcatcccaacaagtgcacaagtctttgaactaaagatctctctgtcttttccggtagctttccagtaaccagcctcagttgctctgttagttctcagtcccgtcggatacttccggtcacggaggctaaagaagtaccattctttctctcccatcttagctctccctaagtaacattgagagtaaagatttcagaaaccttaattacaaaagaactacaagtaagttagttttgtattttcttaccgggaagttgccaaggctcacacttgttgagatcaacttctgcgatggcacggcttgagaagcaaccgtcgaggactttgcggagaaggtaatgagtgatgagctcttcgtccgtgggatgaaacctgaaacccggtggaagatattggctgtctccgccatggtcgtagtggtaatacggaatgtccat

SEQ ID NO: 744 - DNA, 1038 bp, Arabidopsis thaliana
  G508 cDNA Sequence
gctttaaaaagaaccaaacctttataagtgttttttagacattgggagagatgggaaaagatattgagctcccgggttttaggttccacccgactgaggaagagcttcttgatttctacctcaagaacatggtttacggtaagagatcgagtgtcgaagtcattggtttccttaacatataccgtcatgatccatgggacttacctggtttatcgagaatcggggagagggaatggtacttctttgtaccaagggaaaggaagcatgggaacggtgggaggccaagcaggacaactgaaaaaggatattggaaagcaactggatccgatcgtaaaatcataagcttgtctgagccaaaacgtgttatagggctcaagaagacgcttgtgttctatagaggaagagcaccaggaggaagcaagactgattgggtgatgaacgagtttcggatgcccgataattgctccttaccaaaggatgttgtgctttgtaagatatatagaaaagctacttcattgaaagtattggagcaaagggcagagatggaagctaagatgaatcaaacatgtcctaactctcctctttcgtcttccgagacgatttctttcgttggtaaagaagaaaacatgatgacttcgttccgtgctcctcaagtaatagctatggaagaagcaaacaagatccaaatgcatcaagaaaacgcgaaaaccgaagagaaacaaagagaagcagagaccaaagaaccttcttcatcactgaagctaccgtttggaagtttaccagagctacaattaccaaaaccaggagtagaatgggaccagttgttgagtataagcccatggctccagaatcttacaccaatagttaacatatattggtaggatatgtaaagaacaaatacatttaaatattcttactctcgtaaaaaacagagcttgtaccaaatagtatttactaaacttttatgtatcttttgtaattttgtaacataagaaaatttgtaacactatttatagtcatatttgacgatcatttctt

SEQ ID NO: 745 - protein, 276 aa, Arabidopsis thaliana
  G508 Amino Acid Sequence
MGKDIELPGFRFHPTEEELLDFYLKNMVYGKRSSVEVIGFLNIYRHDPWDLPGLSRIGEREWYFFVPRERKHGNGGRPSRTTEKGYWKATGSDRKIISLSEPKRVIGLKKTLVFYRGRAPGGSKTDWVMNEFRMPDNCSLPKDVVLCKIYRKATSLKVLEQRAEMEAKMNQTCPNSPLSSSETISFVGKEENMMTSFRAPQVIAMEEANKIQMHQENAKTEEKQREAETKEPSSSLKLPFGSLPELQLPKPGVEWDQLLSISPWLQNLTPIVNIYW

SEQ ID NO: 746 - DNA, 998 bp, Arabidopsis thaliana
  G508 Genomic Sequence
atgggaaaagatattgagctcccgggttttaggttccacccgactgaggaagagcttcttgatttctacctcaagaacatggtttacggtaagagatcgagtgtcgaagtcattggtttccttaacatataccgtcatgatccatgggacttacctggtaagtacatggcttcttcatttccctaaagattcttttttcctctataagccgtgtattgaaagtctgaattttgatcacaggtttatcgagaatcggggagagggaatggtacttctttgtaccaagggaaaggaagcatgggaacggtgggaggccaagcaggacaactgaaaaaggatattggaaagcaactggatccgatcgtaaaatcataagcttgtctgagccaaaacgtgttatagggctcaagaagacgcttgtgttctatagaggaagagcaccaggaggaagcaagactgattgggtgatgaacgagtttcggatgcccgataattgctccttaccaaaggtaccttaaaaaccaagagctttgtcttgaaaccattatgtgaatcaagaaaacttgttgctcatcttgtgatcaattttgtaggatgttgtgctttgtaagatatatagaaaagctacttcattgaaagtattggagcaaagggcagagatggaagctaagatgaatcaaacatgtcctaactctcctctttcgtcttccgagacgatttctttcgttggtaaagaagaaaacatgatgacttcgttccgtgctcctcaagtaatagctatggaagaagcaaacaagatccaaatgcatcaagaaaacgcgaaaaccgaagagaaacaaagagaagcagagaccaaagaaccttcttcatcactgaagctaccgtttggaagtttaccagagctacaattaccaaaaccaggagtagaatgggaccagttgttgagtataagcccatggctccagaatcttacaccaatagttaacatatattggtag

SEQ ID NO: 747 - DNA, 998 bp, Arabidopsis thaliana; identical to SEQ ID NO: 746
  G508 DNA sequence used for BLAST

SEQ ID NO: 748 - DNA, 1454 bp, Arabidopsis thaliana
  G509 cDNA Sequence
cttcctcctttgctaataaacttttctttgaaccttacacgccttgttgatattactctcttaaatatatattttcgtacattaacacagacatatataaagctaaagatttcttcacgtaatgggtttgaaagatattgggtccaaattgccaccggggtttcgatttcatccaagtgatgaagagttggtttgtcattatctttgcaacaagattagggccaaatctgatcatggtgatgttgatgatgatgatgatgatgttgatgaagctttgaagggttctactgatcttgtggagattgacttgcatatctgtgagccatgggagcttcctgatgtggcaaagttaaacgcaaaggaatggtacttcttcagtttccgtgatcgaaagtatgctactggatatcgcacgaacagagcgacagtaagcggatactggaaagcaacaggaaaagatcgaacggtgatggatccacgtacaaggcaattggtagggatgagaaaaacactagtgttctacagaaacagagcaccaaatgggatcaaaactacttggatcatgcacgagttccgtcttgagtgtcctaacatcccacataaggaagactgggtcttgtgcagagtgttcaacaaaggcagagactcatcgctacaagacaataattattataacaatgataatcagacgcaaaggcttgaagttaatgacgctccggatcttaattacaacaatcagttgccacctttgctatcatcccctcctcataatcatcaacatgagaagatgaaaatccaagtttgtgatcagtgggagcagctaatgaagcagccttcaaggaccaccggccacccctatcatcaccattgtcatcatcaaaccatagcatgtggttgggagcagatgatgatcggttcgctgtcatcaccttcgagtcatggccctgatcacgagtcctttgctaaatttgctttaccgtcgacaataacaacagtgtcaacatcagtggtgatcatcatcagaattatgagaagattttgttgtcatcactagacatgacgagtttggatcacgacaagacatgtatgggatcatcatcggatggtggtatggtctctgatcttcacatggaatgtggtggattgagttttgagaccgaaaatatcctcgctttccaatgaacataattcaaggggttcgccaatttgttgattcgtgaattatacaaacattttatctatagatttatcacattatcaaacatgtaagttgtgtggcatttgggtatagggtttgtgtgattctaggtttttaggacgatgtatgttgttatatttagcgtgtttttaggatttattctcattttaaaattatatgaaaacccattactatgaatacaattagttttctttgttgtaaataatattttagattatcaaaaaaaaaaaaaaaa

SEQ ID NO: 749 - protein, 310 aa, Arabidopsis thaliana
  G509 Amino Acid Sequence
MGLKDIGSKLPPGFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRVFNKGRDSSLQDNNYYNNDNQTQRLEVNDAPDLNYNNQLPPLLSSPPHNHQHEKMKIQVCDQWEQLMKQPSRTTGHPYHHHCHHQTIACGWEQMMIGSLSSPSSHGPDHESFAKFALPSTITTVSTSVVIIIRIMRRFCCHH

SEQ ID NO: 750 - DNA, 3751 bp, Arabidopsis thaliana
  G509 DNA sequence used for BLAST
ctagtgatgacaacaaaatcttctcataattctgatgatgatcaccactgatgttgacactgttgttattgtcgacgtaaagcaaatttagcaaggactcgtgatcagggccatgactcgaaggtgatgacagcgaaccgatcatcatctgctcccaaccacatgctatggtttgatgatgacaatggtgatgataggggtggccggtggtccttgaaggctgcttcattagctgctcccactgatcacaaacttggattttcatcttctcatgttgatgattatgaggaggggatgatagcaaaggtggcaactgattgttgtaattaagatccggagcgtcattaacttcaagcctttgcgtctgattatcattgttataataattattgtcttgtagcgatgagtctctgcctttgttgaacactctgcacaagacccagtcttcctgtgtccacataccgacagaaaacgagaggacatcgttaaaaaataatcaaataaacgtatgtatataaaaatgcatgaaatgttacgttacgtgcggtctcgtgcatgcaaatgaccaaacacgcattaaagccacttttgtctctttcttcaatttttattttgtttttttgttttatctgcatatattcgtcattccttcttttaacttgctgtcatctcatcatgctcacccatgcatacatatatacgttaatacgtacatatatacatacactaatgcttagatacttgactccaaaaataactaactatccggagagtaaacatatgtatagaatctagattggacgtcagaaataaccaaaactagtgtaattaagagatgttgattattaatctcttcatctgacaattcgttttgaatttaagtgtatgattctttacatagtagttaagtgactaagtttaaaaaggtatagccgactgaaacaaacaaataaatggatgaaaaatctctattttaattgaatacacatgcatgattcctcacaatgtttgtgtatatatagtatgatcagatttcgtaagtccagactaaagttcgtgaggtgcaaaatatacagctatagactatatgatattggatggatgtatataaatatgatggattaatggattacgacaattttttgacaagttctaaataaatattgaaagtaattaaaaggatggattcatatgtttatagtgagataacttattgagattttctacctaaaaagaaagaaaaagtatgatctcatttttctttttcaaatttgttttgggataaaataccaatacgctggtaccattaatttggtatctatatctatgcatgggacatccacgaatagacacatgtcgtgagtttaggtacgttgcaagttatggttatcaagacgtaattattatgaaatgatgattactaattatggttagtagtgtcaaagagagaaggaccaattgttggggaataaccaagtaccttaggtgggatgttaggacactcaagacggaactcgtgcatgatccaagtagttttgatcccatttggtgctctgtttctgtagaacactagtgtttttctcatccctaccaattgccttgtacgtggatccatcaccgttcgatcttttcctgttgctttccagtatccgcttactgtcgctctgttcgtgcgatatccagtagcatactttcgatcacggaaactgaagaagtaccattcctttgcgtttaactttgccacatctatacacaacatacaagagatatataatcatcagtaaattcttaaaagtgtttgtcaagatacctatcagtctatcacaatactaactaaatattattttatttttaaacataaaaaatcgtattctaaatattatatataaaagcgtctagtaaatttgaattatggtgactttatggtgattttataccaatttattcaacattaattaattttttgaattgggtttataggctttcgatatagaaacagtgacatgtcaaaggttaatgtggtgatatatgacttgtgtgatgtagacaagacgaggatgtgagacattatattattagttttggcaaaaaaataattacgattttgacttcagcggaggaaattattgctctctcaaacattcctcctatcagtttcacattaatttgatccttacagaagatgatcaagaagataatgtgatgactacttacttaaaaagattcctttattttgccataattgagaagaagagtaatagaccacaattacttttttgtaaacataattatcataaaccatatccaaaatagaatattatatgtatattgcttagttaattatactatttattcatatattcgactatagtaacaacaagatcgtactggtcatgtaaataattaaaggtttcttgagtctctaaagttgcttgtgatatgaggcaaaaaaaggtcttcgtgtttacacacaaagcctacttttttgtttagttaatcttttagtatacatttatattaatgttcattaatgcaactaattaactaactttgtattttataatctgcaagttatcttatttaacaaagtccccaaaagtcaaaattacgaagacaacaaaaacttgaaaaagataagaaaaataaaaagatgacaacaggattctcggtccccttttaaaaaagcttccttaacttctcaaggtatatcatcaaacaaagaaccacaaacaaataatgaaaatcactagaaacatacaaagaacacacatatatatctatatatatatatatcatgttttgatatgatgtaagtgcacctataattattcattaaaatttaccatctgatttacgagtataacgacagctgtgattttgcatattttgctgcttttgtacagcctccagatctttattctataattgcaaacatattattaaaaagctagcatgtatctcaactaatcatgattcatgacactccggataatgtttacactaatattaatgcaattatgatttatgatcataattaatgaatcagtctaaaatctagcatttatgtgaactcatcacccgtttcacaattaaaagatatttgatctttcattcattttctagaatcacgaacaagaagattcggtttgtaagtataagcatatcataaatctgtaaatatgcaaatgcgtagatatgtattaagttgacaaacataattagacacataagtaaacatcatctaattgtaataatactaaaaagtttataggttaagatttacaataacaattaacagacgcggatgataatatctgatttcaagaattagttttcttctttatgttcaattaatttcaggaatattgttttccaatggaaagtttcaagaatctttacgaaagcaatttgaaacccaagaaaagccaggagtgaaaagatagttaaacaaattcatataacctatgactatatatcagtttgaatccaaaaaatatagaattaaatatcagaaatagtagagatatatgttaccaggaagctcccatggctcacagatatgcaagtcaatctccacaagatcagtagaacccttcaaagcttcatcaacatcatcatcatcatcatcaacatcaccatgatcagatttggccctaatcttgttgcaaagataatgacaaaccaactcttcatcacttggatgaaatcgaaaccccggtggcaatttggacccaatatctttcaaacccat

SEQ ID NO: 751 - DNA, 913 bp, Arabidopsis thaliana
  G511 cDNA Sequence
gtttcttgttgttaaaaatatcgtacaaaaatggccgatgaggtcacaatcgggtttcgcttctatcccacggaagaagaactggtttcgttctacctacgaaaccagctcgaaggaaggagtgatgactcaatgcatcgtgtcattcccgtacttgacgtctttgaggtcgagcctagtcatcttccaaatgttgctggagtgagatgtcgaggagacgctgagcaatggttcttcttcgtgccacgacaagaacgcgaagcaagaggaggcagaccgagtagaactactggttcaggatactggaaagcaactggatcacctggtccagtcttttccaaagacaacaaaatgattggagcaaagaaaactatggttttctacactggaaaagcacccacaggaagaaaaactaaatggaaaatgaatgagtaccacgccgttgacgaaacagtcaacgcttccacaatccctaagctgagacgtgagttcagtttatgtcgagtctacataacaacaggaagctccagagcttttgatagacgtcctgagggagttttgcagacagagagaatgctaacaagtgatgttgcagtagctgagacatcgttccgtgtggaaagctcactggaaacttcgatttcaggaggagaacatattgatgtctctatgaacacagagtttgttgatggactatcagaaccgatgtgggactgggaacagctgacttggccttgaagctatatagattttataatcaagcaaatttaaacttgtttcaattgcttattgttagtttgaattttatgacccgaaagattctttttctttctttaccttgtaacgtgagaatttgagaaataataaatgacctagacagtgacatttgaaaaaaaaaaaaaaaaaaaaaaaa

SEQ ID NO: 752 - protein, 235 aa, Arabidopsis thaliana
  G511 Amino Acid Sequence
MADEVTIGFRFYPTEEELVSFYLRNQLEGRSDDSMHRVIPVLDVFEVEPSHLPNVAGVRCRGDAEQWFFFVPRQEREARGGRPSRTTGSGYWKATGSPGPVFSKDNKMIGAKKTMVFYTGKAPTGRKTKWKMNEYHAVDETVNASTIPKLRREFSLCRVYITTGSSRAFDRRPEGVLQTERMLTSDVAVAETSFRVESSLETSISGGEHIDVSMNTEFVDGLSEPMWDWEQLTWP

SEQ ID NO: 753 - DNA, 1112 bp, Arabidopsis thaliana
  G511 Genomic Sequence
aggccaagtcagctgttcccagtcccacatcggttctgatagtccatcaacaaactctgtgttcatagagacatcaatatgttctcctcctgaaatcgaagtttccagtgagctttccacacggaacgatgtctcagctactgcaacatcacttgttagcattctctctgtctgcaaaactccctcaggacgtctatcaaaagctctggagcttcctgttgttatgtagactcgacataaactgaactcacgtctcagctacatttttcaagaaagcaaaaacaaaaaatctcgttattaaaagtaacaagaatgttctaatttaaaagtttttaattatatgcaagtaccttagggattgtggaagcgttgactgtttcgtcaacggcgtggtactcattcattttccatttagtttttcttcctgtgggtgcttttccagtgtagaaaaccatagttttctttgctccaatcattttgttgtctttggaaaagactggaccaggtgatccagttgctttccagtatcctgaaccagtagttctactcggtctgcctcctcttgcttcgcgttcttgtcgtggcacgaagaagaaccattgctcagcgtctcctcgacatctcactccagcaacatctgcaaaattgtgtgagtttcatatataaaaacattacgcatatatagtctttatggcattcatgtattttaggggtgttcaatctgattataccaaacccgaaccaattcaaaaccgactaaaccgatctggaatcgggttactattttcgtaaaacaagaaacccaaacaccaaaatggagaagtttacgtgctataaaacctaactttgtatgatgtcctaatgactctcaagtaatattaagatatgacgattttgatgccatagtagatatatatatcgacaattcaggtgaggttaaccgttaacgtacttggaagatgactaggctcgacctcaaagacgtcaagtacgggaatgacacgatgcattgagtcatcactccttccttcgagctggtttcgtaggtagaacgaaaccagttcttcttccgtgggatagaagcgaaacccgattgtgacctcatcggccat

SEQ ID NO: 754 - DNA, 1115 bp, Arabidopsis thaliana
  G511 DNA sequence used for BLAST
tcaaggccaagtcagctgttcccagtcccacatcggttctgatagtccatcaacaaactctgtgttcatagagacatcaatatgttctcctcctgaaatcgaagtttccagtgagctttccacacggaacgatgtctcagctactgcaacatcacttgttagcattctctctgtctgcaaaactccctcaggacgtctatcaaaagctctggagcttcctgttgttatgtagactcgacataaactgaactcacgtctcagctacatttttcaagaaagcaaaaacaaaaaatctcgttattaaaagtaacaagaatgttctaatttaaaagtttttaattatatgcaagtaccttagggattgtggaagcgttgactgtttcgtcaacggcgtggtactcattcattttccatttagtttttcttcctgtgggtgcttttccagtgtagaaaaccatagttttctttgctccaatcattttgttgtctttggaaaagactggaccaggtgatccagttgctttccagtatcctgaaccagtagttctactcggtctgcctcctcttgcttcgcgttcttgtcgtggcacgaagaagaaccattgctcagcgtctcctcgacatctcactccagcaacatctgcaaaattgtgtgagtttcatatataaaaacattacgcatatatagtctttatggcattcatgtattttaggggtgttcaatctgattataccaaacccgaaccaattcaaaaccgactaaaccgatctggaatcgggttactattttcgtaaaacaagaaacccaaacaccaaaatggagaagtttacgtgctataaaacctaactttgtatgatgtcctaatgactctcaagtaatattaagatatgacgattttgatgccatagtagatatatatatcgacaattcaggtgaggttaaccgttaacgtacttggaagatgactaggctcgacctcaaagacgtcaagtacgggaatgacacgatgcattgagtcatcactccttccttcgagctggtttcgtaggtagaacgaaaccagttcttcttccgtgggatagaagcgaaacccgattgtgacctcatcggccat

SEQ ID NO: 755 - DNA, 1812 bp, Arabidopsis thaliana
  G513 cDNA Sequence
atcgtgtcaaattttagggttttttcttttcgtacttcatcaaattctggaatctggttttttcttagttttcttctatatacctttgaatcgcatctttgatccaaattcattttagatatcaccttgaagtcgaatttgtgattttttcttttcctctcgaattctcaaagtctcacgcaactatgaaagaagacatggaagtactatcgctcgcttcactaccggttgggttcagatttagtccaacggacgaagagttagtccggtactatctccggctcaagatcaacggtcacgataacgacgttagagtaattcgtgagatcgatatctgcaaatgggagccttgggatttgcctgatttttctgtggtgaagacaacagactcagagtggctcttcttttgtcctttggaccggaaatatccgagtggaagtcgaatgaatagagctactgtggctggatactggaaggcgacgggaaaagaccgtaagatcaaatcaggaaagactaagattataggtgttaagaggactctagtgttttatacaggtcgtgctcctaaagggacacgaacttgttggattatgcatgagtatcgtgctactgagaaggatcttgatggaacaaagtctggccagaatccgtttgttgtttgtaagttgtttaagaagcaagatattgtgaacggagctgctgaaccagaagagtcaaagtcatgtgaagttgaaccagcggtatcgtctccaactgttgtggacgaggttgaaatgtctgaggtatctcctgttttccctaaaacagaagagactaatccttgtgacgtcgcagagtcttctcttgtaatccccagcgaatgtcgtagtggatactctgtccctgaggttacaaccaccgggcttgacgatatcgattggctctcgtttatggagtttgattccccgaagctgttctctccgttgcactctcaggtgcaatctgagctcggttcctctttcaatggcttacaatctgagtctagtgaattgttcaaaaaccacaatgaggattacattcagactcagtacggtacaaatgatgcggatgaatatatgtccaagttcttggattcttttcttgacattccctatgagccagaacagatcccatatgagccacagaatcttagctcatgcaacaagatcaatgatgaatctaagagaggaattaagattagagctcgacgagcacaagccccgggttgtgctgagcagtttgtaatgcagggcgatgcctcaagaaggctgcgtcttcaggttaaccttaacagccacaagtcagaaactgacagtacacaacttcaatttatcaagaaagaggttaaggacacaacaacggaaactatgacgaaaggatgtggaaatttcacaagatcaaagagcaggactagtttcatattcaagaaaattgcagccatgggatgttcatacagagggcttttcagagtcggtgtggtagcggttgtgtgtgtgatgtcggtctgcagtctagtcgcataaatccgctgaatgtgatgtttgttccgatcaattcatatagtaagaataaagaaagtggtttttacgggtggagagagcgcggatttgtgtgtataacaggggttttggcctggttctgcatctgttgttattgttgttgtttttgtcggcttaagcttaaccatggtcggtttaggagtgtagtagacttgtagttaacatgtacgacgactcataatattcagatggtaatgtttggaaatttttttattcctaaaaaaaaaaaaaaaaa

SEQ ID NO: 756 - protein, 451 aa, Arabidopsis thaliana
  G513 Amino Acid Sequence
MKEDMEVLSLASLPVGFRFSPTDEELVRYYLRLKINGHDNDVRVIREIDICKWEPWDLPDFSVVKTTDSEWLFFCPLDRKYPSGSRMNRATVAGYWKATGKDRKIKSGKTKIIGVKRTLVFYTGRAPKGTRTCWIMHEYRATEKDLDGTKSGQNPFVVCKLFKKQDIVNGAAEPEESKSCEVEPAVSSPTVVDEVEMSEVSPVFPKTEETNPCDVAESSLVIPSECRSGYSVPEVTTTGLDDIDWLSFMEFDSPKLFSPLHSQVQSELGSSFNGLQSESSELFKNHNEDYIQTQYGTNDADEYMSKFLDSFLDIPYEPEQIPYEPQNLSSCNKINDESKRGIKIRARRAQAPGCAEQFVMQGDASRRLRLQVNLNSHKSETDSTQLQFIKKEVKDTTTETMTKGCGNFTRSKSRTSFIFKKIAAMGCSYRGLFRVGVVAVVCVMSVCSLVA

SEQ ID NO: 757 - DNA, 1995 bp, Arabidopsis thaliana
  G513 Genomic Sequence
caagtctactacactcctaaaccgaccatggttaagcttaagccgacaaaaacaacaacaataacaacagatgcagaaccaggccaaaacccctgttatacacacaaatccgcgctctctccacccgtaaaaaccactttctttattcttactatatgaattgatcggaacaaacatcacattcagcggatttatgcgactagactgcagaccgacatcacacacacaaccgctaccacaccgactctgaaaagccctctgtatgaacatcccatggctgcaattttcttgaatatgaaactagtcctgctctttgatcttgtgaaatttccacatcctttcgtcatagtttccgttgttgtgtccttaacctatatacattttatcgcataaatataaggatcataaattgtaatacatgagaaggtatgaaaacaaacttcttctcacctctttcttgataaattgaagttgtgtactgtcagtttctgacttgtggctgttaaggttaacctgaagacgcagccttcttgaggcatcgccctgcattacaaactgctcagcacaacccggggcttgtgctcgtcgagctctaatcttaattcctctcttagattcatcattgatcttgttgcatgagctaagattctgtggctcatatgggatctgttctggctcatagggaatgtcaagaaaagaatccaagaacttggacatatattcatccgcatcatttgtaccgtactgagtctgaatgtaatcctcattgtggtttttgaacaattcactagactcagattgtaagccattgaaagaggaaccgagctcagattgcacctgagagtgcaacggagagaacagcttcggggaatcaaactccataaacgagagccaatcgatatcgtcaagctgttgagtaaaatgaagtttgtaagtttacaaagcggttgtaccgcctcctgtaatgaaaagaatgtattttgttcatccttaccccggtggttgtaacctcagggacagagtatccactacgacattcgctggggattacaagagaagactctgcgacgtcacaaggattagtctcttctgttttagggaaaacaggagatacctcagacatttcaacctcgtccacaacagttggagacgataccgctggttcaacttcacatgactttgactcttctggttcagcagctccgttcacaatatcttgcttcttaaacaacttacaaacaacaaacggattctgcaaccaaaaacaatcaaacaaacacaatcagaaacacaaaagacctacacacacaagttaatgccatcatttgccaagttggtttttacctggccagactttgttccatcaagatccttctcagtagcacgatactcatgcataatccaacaagttcgtgtccctttaggagcacgacctgtataaaacactagagtcctcttaacacctataatcttagtctttcctgatttgatcttacggtcttttcccgtcgccttccagtatccagccacagtagctctattcattcgacttccactcggatatttccggtccaaaggacaaaagaagagccactctgagtctgttgtcttcaccacagaaaaatctacaccacaaatactaaagtataaatctttactcaaattcactaagtccactacctaagctaagaagttattgatcatattgttccaaattcaaacatgcataaaccggaattgaagcctgggaattgctaaaccgagactaaagagctaaagatgaatcaacgaattgatttgatgaagaaaggaattaccaggcaaatcccaaggctcccatttgcagatatcgatctcacgaattactctaacgtcgttatcgtgaccgttgatcttgagccggagatagtaccggactaactcttcgtccgttggactaaatctgaacccaaccggtagtgaagcgagcgatagtacttccatgtcttctttcat

SEQ ID NO: 758 - DNA, 1804 bp, Arabidopsis thaliana
  G513 DNA sequence used for BLAST
ttatgcgactagactgcagaccgacatcacacacacaaccgctaccacaccgactctgaaaagccctctgtatgaacatcccatggctgcaattttcttgaatatgaaactagtcctgctctttgatcttgtgaaatttccacatcctttcgtcatagtttccgttgttgtgtccttaacctatatacattttatcgcataaatataaggatcataaattgtaatacatgagaaggtatgaaaacaaacttcttctcacctctttcttgataaattgaagttgtgtactgtcagtttctgacttgtggctgttaaggttaacctgaagacgcagccttcttgaggcatcgccctgcattacaaactgctcagcacaacccggggcttgtgctcgtcgagctctaatcttaattcctctcttagattcatcattgatcttgttgcatgagctaagattctgtggctcatatgggatctgttctggctcatagggaatgtcaagaaaagaatccaagaacttggacatatattcatccgcatcatttgtaccgtactgagtctgaatgtaatcctcattgtggtttttgaacaattcactagactcagattgtaagccattgaaagaggaaccgagctcagattgcacctgagagtgcaacggagagaacagcttcggggaatcaaactccataaacgagagccaatcgatatcgtcaagctgttgagtaaaatgaagtttgtaagtttacaaagcggttgtaccgcctcctgtaatgaaaagaatgtattttgttcatccttaccccggtggttgtaacctcagggacagagtatccactacgacattcgctggggattacaagagaagactctgcgacgtcacaaggattagtctcttctgttttagggaaaacaggagatacctcagacatttcaacctcgtccacaacagttggagacgataccgctggttcaacttcacatgactttgactcttctggttcagcagctccgttcacaatatcttgcttcttaaacaacttacaaacaacaaacggattctgcaaccaaaaacaatcaaacaaacacaatcagaaacacaaaagacctacacacacaagttaatgccatcatttgccaagttggtttttacctggccagactttgttccatcaagatccttctcagtagcacgatactcatgcataatccaacaagttcgtgtccctttaggagcacgacctgtataaaacactagagtcctcttaacacctataatcttagtctttcctgatttgatcttacggtcttttcccgtcgccttccagtatccagccacagtagctctattcattcgacttccactcggatatttccggtccaaaggacaaaagaagagccactctgagtctgttgtcttcaccacagaaaaatctacaccacaaatactaaagtataaatctttactcaaattcactaagtccactacctaagctaagaagttattgatcatattgttccaaattcaaacatgcataaaccggaattgaagcctgggaattgctaaaccgagactaaagagctaaagatgaatcaacgaattgatttgatgaagaaaggaattaccaggcaaatcccaaggctcccatttgcagatatcgatctcacgaattactctaacgtcgttatcgtgaccgttgatcttgagccggagatagtaccggactaactcttcgtccgttggactaaatctgaacccaaccggtagtgaagcgagcgatagtacttccatgtcttctttcat

SEQ ID NO: 759 - DNA, 1217 bp, Arabidopsis thaliana
  G514 cDNA Sequence
tccaagatcaaatcaagaaacccattaaaaaaaaaaatcaggttttggtttcagttttaagggtttaaggtttcttggggaagaaacgatggagactttttgtgggtttcaaaaggaggaagagcagatggatttacctcctgggttcaggtttcatccaacagatgaagaactcataactcactatctccataataaggttcttgacaccagcttctcagctaaagctatcggtgaagttgatttaaacaaatcagagccatgggagttaccatggatggcaaaaatgggtgagaaagaatggtattttttctgtgtgagagacagaaagtatcccaccggtttaagaactaaccgagcaactgaagccggttattggaaggcgaccgggaaggataaagagatataccgaggcaaatcacttgttgggatgaagaagacacttgttttctatagaggaagagctcctaaaggtcagaaaaccaactgggtgatgcatgagtacaggcttgaaggaaaattctctgcccataacttgccgaaaaccgcaaagaagtgggtatgcagggtgttccaaaagagtgctggagggaagaagatcccgatttcgagtctaatccgaatcggttcactcggaaccgactttaacccttcgcttttgccctctttaaccgattcttcgccttacaacgataaaaccaaaacagaaccggtctacgtgccctgcttctccaaccaaacggatcaaaaccaaggaaccacactcaattgcttcagcagccctgttcttaactcgatccaagccgacatttttcacaggattccactctatcaaactcagtccctccaggtttctatgaatctacagagcccggttctcacgcaagaacactcagttctacatgctatgatcgagaacaacagaagacaaagtctcaaaacgatgagtgtctcacaagaaaccggagtttcaactgacatgaacactgatatctcatcggattttgaatttggtaagagacggtttgattctcaagaagatccgtcttcctctactggaccggttgatcttgaacctttctggaattactgaagatgattcaagattctcatgtccattaatttactgtggtgtgttaaagtttgtataggctattgtcatatactctcatatcaacttccactatatattataacaaattaaagaaacttaaaaa

SEQ ID NO: 760 - protein, 334 aa, Arabidopsis thaliana
  G514 Amino Acid Sequence
METFCGFQKEEEQMDLPPGFRFHPTDEELITHYLHNKVLDTSFSAKAIGEVDLNKSEPWELPWMAKMGEKEWYFFCVRDRKYPTGLRTNRATEAGYWKATGKDKEIYRGKSLVGMKKTLVFYRGRAPKGQKTNWVMHEYRLEGKFSAHNLPKTAKKWVCRVFQKSAGGKKIPISSLIRIGSLGTDFNPSLLPSLTDSSPYNDKTKTEPVYVPCFSNQTDQNQGTTLNCFSSPVLNSIQADIFHRIPLYQTQSLQVSMNLQSPVLTQEHSVLHAMIENNRRQSLKTMSVSQETGVSTDMNTDISSDFEFGKRRFDSQEDPSSSTGPVDLEPFWNY

SEQ ID NO: 761 - DNA, 1226 bp, Arabidopsis thaliana
  G514 DNA sequence used for BLAST
tcagtaattccagaaaggttcaagatcaaccggtccagtagaggaagacggatcttcttgagaatcaaaccgtctcttaccaaattcaaaatccgatgagatatcagtgttcatgtcagttgaaactccggtttcttgtgagacactcatcgttttgagactttgtcttctgttgttctcgatcatagcatgtagaactgagtgttcttgcgtgagaaccgggctctgtagattcatagaaacctggagggactgagtttgatagagtggaatcctgtgaaaaatgtcggcttggatcgagttaagaacagggctgctgaagcaattgagtgtggttccttggttttgatccgtttggttggagaagcagggcacgtagaccggttctgttttggttttatcgttgtaaggcgaagaatcggttaaagagggcaaaagcgaagggttaaagtcggttccgagtgaaccgattcggattagactcgaaatcgggatcttcttccctccagcactcttttggaacaccctgcatatcacccattcattctgcaaaccccaaaacaaaaacaaaattagtaaacaaaaggaaaacagagcataaacagagtaagtgtttggttttcgggttaacctttgcggttttcggcaagttatgggcagagaattttccttcaagcctgtactcatgcatcacccagttggttttctgacctttaggagctcttcctctatagaaaacaagtgtcttcttcatcccaacaagtgatttgcctcggtatatctctttatccttcccggtcgccttccaataaccggcttcagttgctcggttagttcttaaaccggtgggatactttctgtctctcacacagaaaaaataccattctttctcacccatttttgccatccctatatacacaaaaaaatcaatcttccaacaacattagctctcaagaagaagacaaagagaacacttgtttagattcagaaaaaaaaaagactttaaaacttgaaatcctgatttatgatcaaaacatacatggtaactcccatggctctgatttgtttaaatcaacttcaccgatagctttagctgagaagctggtgtcaagaaccttcttatggagatagtgagttatgagttcttcatctgttggatgaaacctgaacccaggaggtaaatccatctgctcttcctccttttgaaacccacaaaaagtctccat

SEQ ID NO: 762 - protein, 253 aa, Arabidopsis thaliana
  G516 Amino Acid Sequence
MSMKSLAQLIFVASTLGTYLVSLSNASVCFSLVPNCCIIPVISDHVLSFPAHSRMKTRDQVWYFFGRKENKYGKGDRQIRKTKSGFWKKTGVTMDIMRKTGDREKIVKFKGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTVSKIFLFYLYYLLCFQFFLTKL

SEQ ID NO: 763 - DNA, 1553 bp, Arabidopsis thaliana
  G516 Genomic Sequence
atgctcaccaatctcagtcccttgtgcatcattatcaataccggttcccggtgttttgctcaccttaaatcacatcatagaacccaaaatgctgtgagtactggcacaaagtagcttggttaattagcagtttagaatggttggtctttaagaaaaggagatgataaagctcacctcttgagctaatgacactaacttgattgagttaggagattcctgcaagtcagtgatttggtatagaggatttgagctaccaaaactaggacaagtgcttaaagtttgaatggaaatctgtcgtattaaacaaaactatagctttgtgagaaaaaactgaaaacagaggagatagtaaaggtaaaataggaaaattttgcttacagttgttgcagaaatcggatcagaatcactaccatcggtgctatgatcactgaagacaccggtcaatggcttttgaggtgtgtggttgttgcgatcatcttgcatagaaacaatcttactctgctcatcgtcatcattaaagaagcctttgaaatcatcactcaaaatattgcagaagtccctatctagtgcatccacatcaagaaagccagaaaactgacttggattctgtgattcttggctgtgaaacaacgatccctgaaaaaaggaacaacgtaacacagatgaaaaaactatgtgtacgagatatgattttgaagatttaaaagagaaacagggaaagtttttgagattgactcacctctgtctctacactcaaaactccagaattgttggtaggagggattaaagagtgagtatgcttaattccactaccagtagcaactgaaaattctctcctttcacccttaaacttaactttgcagagtgtgtatgtcattatctacagatcaactcagcataaatgattaccataaactcagatttttcccgtttacgagaaataaaatcacggtaagaaaacaacaacaacaagttaaagaagcctaaacaagagaatcgaaaaatgacctgattaggagacgagaacgtagcgtgatactcatgcatagcccaatcggacttggaaccaccgtgattcttaaacaccaaaacccttttctcaccgatctcctcacgatctcccgttttgcgcattatatccatggtaacgccagttttcttccaaaaaccagacttggtttttcttatctgtcgatcacctttaccatatttgttctccttacggccgaagaaataccaaacctgatctcttgttttcatcctagaatgggctgggaaagacagaacatgatcagaaattaccgggatgatacaacagttgggaaccaaagaaaaacaaacactcgcgttagaaagacttacaaggtaagtcccaagggtcgaagctacaaatatcaactgtgctaatgacttcatcgacatggctcgtgttactttcgagatttttcggtcggaggtaaatgtcgacgatctccccgtcagtcggacggaatctaaaacccaccggattcgccatttttcaacagctacaaaaaggttcagatcaaaactaa

SEQ ID NO: 764 - DNA, 1609 bp, Arabidopsis thaliana
  G516 DNA sequence used for BLAST
tcatgttcttaggtgaattttcttgacgaatttttgtatcatcctgtgaaagaaaccagctcttttgttcttgatcgtctcttgacccaatttatgctcaccaatctcagtcccttgtgcatcattatcaataccggttcccggtgttttgctcaccttaaatcacatcatagaacccaaaatgctgtgagtactggcacaaagtagcttggttaattagcagtttagaatggttggtctttaagaaaaggagatgataaagctcacctcttgagctaatgacactaacttgattgagttaggagattcctgcaagtcagtgatttggtatagaggatttgagctaccaaaactaggacaagtgcttaaagtttgaatggaaatctgtcgtattaaacaaaactatagctttgtgagaaaaaactgaaaacagaggagatagtaaaggtaaaataggaaaattttgcttacagttgttgcagaaatcggatcagaatcactaccatcggtgctatgatcactgaagacaccggtcaatggcttttgaggtgtgtggttgttgcgatcatcttgcatagaaacaatcttactctgctcatcgtcatcattaaagaagcctttgaaatcatcactcaaaatattgcagaagtccctatctagtgcatccacatcaagaaagccagaaaactgacttggattctgtgattcttggctgtgaaacaacgatccctgaaaaaaggaacaacgtaacacagatgaaaaaactatgtgtacgagatatgattttgaagatttaaaagagaaacagggaaagtttttgagattgactcacctctgtctctacactcaaaactccagaattgttggtaggagggattaaagagtgagtatgcttaattccactaccagtagcaactgaaaattctctcctttcacccttaaacttaactttgcagagtgtgtatgtcattatctacagatcaactcagcataaatgattaccataaactcagatttttcccgtttacgagaaataaaatcacggtaagaaaacaacaacaacaagttaaagaagcctaaacaagagaatcgaaaaatgacctgattaggagacgagaacgtagcgtgatactcatgcatagcccaatcggacttggaaccaccgtgattcttaaacaccaaaacccttttctcaccgatcttctcacgatctcccgttttgcgcattatatccatggtaacgccagttttcttccaaaaaccagacttggtttttcttatctgtcgatcacctttaccatatttgttctccttacggccgaagaaataccaaacctgatctcttgttttcatcctagaatgggctgggaaagacagaacatgatcagaaattaccgggatgatacaacagttgggaaccaaagaaaaacaaacactcgcgttagaaagacttacaaggtaagtcccaagggtcgaagctacaaatatcaactgtgctaatgacttcatcgacatggctcgtgttactttcgagatttttcggtcggaggtaaatgtcgacgatctccccgtcagtcggacggaatctaaaacccaccggattcgccat

SEQ ID NO: 765 - DNA, 1106 bp, Arabidopsis thaliana
  G523 cDNA Sequence
cttgtaccggaatcaggtttttgcttttcttctagggtttaaggttatttaaaaacagatggaaactttcggtgtgtttcacaaggaagatgatgagcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatataaagcaaaaattggtgagaaagaatggtactttttctgtgtgagggatagaaagtatccgactggtctgaggactaaccgagcaactcaagccggttattggaaggcgacagggaaggataaagagatcttccgaggcaaatcgcttgttggtatgaagaaaacacttgttttctacagaggaagagctcctaaaggccagaaaacaaattgggtgatgcatgagtataggctagatggaaaactctctgctcacaacttgcctaaaaccgctaagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattactgaagattcagaacctggaaaggctattaatttaaggtcaccaagtaaagaaaatcttttg

SEQ ID NO: 766 - protein, 329 aa, Arabidopsis thaliana
  G523 Amino Acid Sequence
METFGVFHKEDDEQMDLPPGFRFHPTDEELITHYLHKKVLDLGFSAKAIGEVDLNKAEPWELPYKAKIGEKEWYFFCVRDRKYPTGLRTNRATQAGYWKATGKDKEIFRGKSLVGMKKTLVFYRGRAPKGQKTNWVMHEYRLDGKLSAHNLPKTAKNEWVICRVFHKTAGGKKIPISTLIRIGSYGTGSSLPPLTDSSPYNDKTKTEPVYVPCFSNQAETRGTILNCFSNPSLSSIQPDFLQMIPLYQPQSLNISESSNPVLTQEQSVLQAMMENNRRQNFKTLSISQETGVSNTDNSSVFEFGRKRFDHQEVPSPSSGPVDLEPFWNY

SEQ ID NO: 767 - DNA, 1228 bp, Arabidopsis thaliana
  G523 Genomic Sequence
atggaaactttcggtgtgtttcacaaggaagatgatgagcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatgtaggttttaaaaaaaaacataatttagcaacacacatccccccatgtctaaattcaaacaaggttttgaagtctaatgagttctgttttttggtgttttttgttttttgttaaacagataaagcaaaaattggtgagaaagaatggtactttttctgtgtgagggatagaaagtatccgactggtctgaggactaaccgagcaactcaagccggttattggaaggcgacagggaaggataaagagatcttccgaggcaaatcgcttgttggtatgaagaaaacacttgttttctacagaggaagagctcctaaaggccagaaaacaaattgggtgatgcatgagtataggctagatggaaaactctctgctcacaacttgcctaaaaccgctaaggtcaaataaaaacaatccaagctttgctctgtttcttgctctgttttacaactctgtttttgttttgttttgtttttttttccatttgtttgataatttttggggtttggttccatttggcagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattac

SEQ ID NO: 768 - DNA, 1231 bp, Arabidopsis thaliana
  G523 DNA sequence used for BLAST
atggaaactttcggtgtgtttcacaaggaagatgatgagcagatggatttgcctcctggttttaggtttcatccaacagacgaagaactcataacccactatctccacaagaaggttcttgaccttggtttctcggctaaagctattggtgaggttgatttgaacaaagctgagccatgggagttgccatgtaggttttaaaaaaaaacataatttagcaacacacatccccccatgtctaaattcaaacaaggttttgaagtctaatgagttctgttttttggtgttttttgttttttgttaaacagataaagcaaaaattggtgagaaagaatggtactttttctgtgtgagggatagaaagtatccgactggtctgaggactaaccgagcaactcaagccggttattggaaggcgacagggaaggataaagagatcttccgaggcaaatcgcttgttggtatgaagaaaacacttgttttctacagaggaagagctcctaaaggccagaaaacaaattgggtgatgcatgagtataggctagatggaaaactctctgctcacaacttgcctaaaaccgctaaggtcaaataaaaacaatccaagctttgctctgtttcttgctctgttttacaactctgtttttgttttgttttgtttttttttccatttgtttgataatttttggggtttggttccatttggcagaatgaatgggtgatctgcagggtatttcataaaactgctggaggtaagaagatcccgatttcgacgttaatccgaatcggttcttacggaaccgggtctagtttaccacctttaactgattcttcaccatacaacgacaaaaccaagaccgaaccagtttacgtgccctgcttctccaaccaagctgaaactagaggaacaatactcaattgcttcagcaacccttcccttagctccatccaaccagattttctccagatgattccactctaccaacctcaatctctcaacatttccgagagttccaatccggttcttacgcaagaacaatcagttttacaagcgatgatggaaaacaacagaaggcagaacttcaaaacattgagcatctcgcaagaaaccggggtttcgaacaccgataactcatcggtttttgaatttgggaggaagcgatttgatcatcaagaagttccatctccctcttccggtccggttgatcttgaacctttctggaattactga

SEQ ID NO: 769 - DNA, 1062 bp, Arabidopsis thaliana
  G524 cDNA Sequence
ttcgtctctctttctacggttcaaacattaaaaagatagatggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatagattaacaaacttgggaacaacttctattaactttaataaattagattatgattgtttccaaagttaattatgcaatccaggagtctttcttggttttggtaattaatagccatattttatagcttatctaattgtatcaaatattgaaaactggttgatcaaatatctaatttgttaaaaaaaaaaaaaaaaaaaaaaaaaaaaaaaaaaaaaaaa

SEQ ID NO: 770 - protein, 268 aa, Arabidopsis thaliana
  G524 Amino Acid Sequence
MEKRSSIKNRGVLRLPPGFRFHPTDEELVVQYLRRKVTGLPLPASVIPETDVCKSDPWDLPGDCESEMYFFSTREAKYPNGNRSNRSTGSGYWKATGLDKQIGKKKLVVGMKKTLVFYKGKPPNGTRTNWVLHEYRLVDSQQDSLYGQNMNWVLCRVFLKKRSNSNSKRKEDEKEEVENEKETETEREREEENKKSTCPIFYDFMRKDTKKKRRRRRCCDLNLTPATCCCCSSSTSSSSVCSSALTHTSSNDNRQEISYRENKFCLFL

SEQ ID NO: 771 - DNA, 973 bp, Arabidopsis thaliana
  G524 Genomic Sequence
atggagaagaggagctctattaaaaacagaggagtacttagattaccaccagggttccgatttcacccgaccgatgaagagctagtggttcaatatttacgtcgaaaagtaaccggtttacccttaccagcttctgtaataccggaaaccgatgtttgtaaatccgatccatgggatttaccaggtacagaaattgaaaaatctactctagggtttcattcaaattcaatatttgatggtgtatatgcatgatgatcacaggtgattgtgaatcagagatgtatttttttagcacgagggaagctaaatacccgaacggaaaccggtcgaaccggtctaccggttcgggttattggaaagcgactggtctcgataagcagatcggtaagaagaagcttgtcgtggggatgaagaaaactcttgttttctacaaaggtaaaccaccaaacggaacaagaactaactgggttcttcatgaatatcgtcttgttgattcacaacaagattcattatatgtaagagaatcaaattcaaataaattagattcatcaatcagttggataaaaacttggctaaaaagtgtattttaatgtgtttttaaaagggacagaacatgaattgggttttgtgtagagtgttcttgaagaagagaagcaatagtaatagtaagaggaaagaagatgagaaagaagaggtggagaatgagaaagagacagagacagagagagaacgtgaggaggagaacaagaagagtacttgtcccatattttatgactttatgagaaaagacacgaagaaaaagagaaggagaagaagatgctgtgatttgaatttgactcctgctacttgttgttgttgctcttcttcgacttcttcgtcgtctgtttgctcaagtgctttaactcacacatcttctaatgataatcgtcaagaaatcagttatcgggaaaataagttttgtttgtttctatag

SEQ ID NO: 772 - DNA, 973 bp, Arabidopsis thaliana; identical to SEQ ID NO: 771
  G524 DNA sequence used for BLAST

SEQ ID NO: 773 - DNA, 1179 bp, Arabidopsis thaliana; identical to SEQ ID NO: 11
  G525 cDNA Sequence

SEQ ID NO: 774 - protein, 285 aa, Arabidopsis thaliana
  G525 Amino Acid Sequence
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 775 - DNA, 1057 bp, Arabidopsis thaliana
  G525 Genomic Sequence
gaaattccaaacgcaatccaattcttctgtaccggacgaatcacgaccgtcgaaaggtttgccggagaattgagtttcttgaccgtcaagcaacagcttcattagcgaataattgtcttgtaaaaacagaggatccgagtaaaacagagaaccaaaaccgtctttggactcgtggacaagtcttttgtcttcggtttcttggtcggagaagcaggtcacgtgagacgacgaaccggtgaaggagtctcgttgagaacaatccattaacgaaggtaaaccggctggttccattcggttaatgtgtggatcaagcattgacattggaacctttgtaccatcggcacgtttttggaaaacacgacatataacccattcgttctacattcacaaacaaccaaacaaaagaattaatttcaagtccccaaaaaaaacaaaagacagaaacacacaaaatctcttaatgttattaccttagctgtttggggaagattttcaatacaatatttgccttctaaacgatattcatgcataacccaattggttttaactcctttaggagctcttcctttatagaaaaccaaagttttcttcatacccacaagtgattttcccttgaatatctctttgtcttttcctgtggctttccaataaccggcttctgtcgcccggtttgtccttaaaccggtcgggtatttccggtctctcacacagaagaaataccattctttttctcccatcttagccttccctgttccaacaaaaccagccatgtatcagaattcagaaccatgagtttaatggtagaaagaagacaaacaaaagacttgaggaaatagaaagataaggtgtgaaacttacatggtaagtcccaaggctcaatcttgttgagatcaacttcaccaatggcagtagcagagaagaaagtgttgaaaacctttggtttgaggtagtgagttatgagttcttcatcagtagggtgaaatctgaatcctggtggtagatctatatgttcttcatcttctaccatttcgacgattcttgatgcctcgtaatccat

SEQ ID NO: 776 - DNA, 1057 bp, Arabidopsis thaliana; identical to SEQ ID NO: 775
  G525 DNA sequence used for BLAST

SEQ ID NO: 777 - DNA, 1481 bp, Arabidopsis thaliana; identical to SEQ ID NO: 27
  G526 cDNA Sequence

SEQ ID NO: 778 - protein, 335 aa, Arabidopsis thaliana
  G526 Amino Acid Sequence
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 779 - DNA, 1500 bp, Arabidopsis thaliana
  G526 Genomic Sequence
gaagtcccacaagtcccccctcaagtcacatagatcttcatacgacttgctaccattcaccattcccatcatccccatttcttgtttcattacaggacccgaagatacctccgtggttgtagtcatgttcgcgttcacatctgagcttaggcatgtttcttgagatacactaacaagtgattgctccatcttgatcatctcgttgttgttgttgtacgtagagcccgaagcagaaccaaaaacctggtggttaaagattgattggtaagaattgaaatgatggggttggattggtgatgagatatcgtaagttggagggttgatgggtttgaagtttggttgttcggtttgactcatgaaactcgggtctatgagaggaggaagagatgagaagtctaggagatgatcaatgttctctagagaatccatccttgtgaaatcttcaacgggtattctcgtcattggttgggttgtggtagaaggattgttcttgtgaaaaaccctacacacgacccattcgtcctgtaatcaaagatcataaacaaacaaaagtatagattagtttttatttttgaagttaggattcaattatcttaaattggatatatgaaaacgaatcaaactcttttgaaaaggacttatgttttccaccatatataacacacttttggtttaagaaaactaagacataataatcaaataaatcttagatctttctccttttggagtcgaattgaaaaaaacattgagaatatatggtttcgtaacataaactcacccttgcagattttgggagattgtaatacgaatatttgccttcaagacgatattcatgcatgacccaattagtcttttcaccttttggagctcttcctctataaaacacaagtgttttcttcatcccaacgagacaacctttgcctttgaagatctccttatccttcccggtggctttccagtatcctgactccgtcgcacggttcgtcctcatcccagtcggatacttcctgtccctttgacagaagaagtagaactctttctcccccatctttgccctctctataccaaccaaaaacaaaaatcagaatcttgatcaagaagccttttgtgtgttgaaatggtcaaagaagattgaaatttgtttggcttcgaagtttgaaaatttggttcaaaaacaagttagacatcaagaattgataaatcttaatcaagaagctatagcctttgtgtttacacatgaatggtcaaagaaaaattgaaattttgttttggtttatggaaaattgactactacttacttggcaaatcccaaggctcacacttgttgagatcagcttctcccatggccacagccgtgaatcggctgtttaaaaccttctccttaaggtaacatgttatgatctcttcgtctgttggatgaaacctgaaaccaggtggcaaatccacaagctcttcacctccatgattcaacaccacaccttcttcaaccacaaccgccat

SEQ ID NO: 780 - DNA, 1500 bp, Arabidopsis thaliana; identical to SEQ ID NO: 779
  G526 DNA sequence used for BLAST

SEQ ID NO: 781 - DNA, 1040 bp, Arabidopsis thaliana
  G528 cDNA Sequence
ccacgcgtccgccattaaacaaaaaaaaatcaaatctctctctttctctctctaatggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggatatcgcagctgcggatatggcacctactcatccgataaggcttggtctggccctgaatttctcagtgttctactatgagattctcaattcttcagacaaagcttgtaacatggccaaacaggcttttgaggaggccatagctgagcttgacactctgggagaggaatcctacaaagacagcactctcataatgcagttgctgagggacaatttaaccctttggacctccgatatgcaggagcagatggacgaggcctgaggatctagatgaagggggggagggttgttacgcgatgtttctgccaccaaatcgatctcaaaatccccataacctttgctcaaaaactgtgaaaaaagattgaagtgtttatgatgattatgattgtgcacagcttgatgatttatctactctactaaacctctgtgctcttaatatttattgtctcgactctgctcaagccttaaaaacatctttctccttaaaaaaaaaaaaaaaaa

SEQ ID NO: 782 - protein, 248 aa, Arabidopsis thaliana
  G528 Amino Acid Sequence
MAATLGRDQYVYMAKLAEQAERYEEMVQFMEQLVTGATPAEELTVEERNLLSVAYKNVIGSLRAAWRIVSSIEQKEESRKNDEHVSLVKDYRSKVESELSSVCSGILKLLDSHLIPSAGASESKVFYLKMKGDYHRYMAEFKSGDERKTAAEDTMLAYKAAQDIAAADMAPTHPIRLGLALNFSVFYYEILNSSDKACNMAKQAFEEAIAELDTLGEESYKDSTLIMQLLRDNLTLWTSDMQEQMDEA

SEQ ID NO: 783 - DNA, 1786 bp, Arabidopsis thaliana
  G528 Genomic Sequence
atggcggcgacattaggcagagaccagtatgtgtacatggcgaagctcgccgagcaggcggagcgttacgaagagatggttcaattcatggaacagctcgttacaggcgctactccagcggaagagctcaccgttgaagagaggaatctcctctctgttgcttacaaaaacgtgatcggatctctacgcgccgcctggaggatcgtgtcttcgattgagcagaaggaagagagtaggaagaacgacgagcacgtgtcgcttgtcaaggattacagatctaaagttgagtctgagctttcttctgtttgctctggaatccttaagctccttgactcgcatctgatcccatctgctggagcgagtgagtctaaggtcttttacttgaagatgaaaggtgattatcatcggtacatggctgagtttaagtctggtgatgagaggaaaactgctgctgaagataccatgctcgcttacaaagcagctcaggttattttcattctccaaatctgatttggctgataagttttgtttgtgaactctgtttacgagatttcttctattggtaatagcttccaaatctagtaattatgtcctgatctagaattggtctctaattgagctactatgcttatcaaatcatgagaaagtagattgctgttttgtttcagtttttgtcttaaagagtaaaaattgctttcttcaaactgatggagatgtttttgtctatttttcgatgtgatgttttttgaaggatatcgcagctgcggatatggcacctactcatccgataaggcttggtctggccctgaatttctcagtgttctactatgagattctcaattcttcagacaaagcttgtaacatggccaaacaggttactcttcttctttctttttcgctgcttgcctcaattaggaacatctctttctctctctttccgttgcctctctggtaacaaacatataagtcgttgacctgagtttgtctcttgagagtttgcttctgtttcttgctttatgttattacaaaagagaattgaccacttgttgactagtcttgttgtacttttttcttttcttaagatgtattgttgggtaaagaaccaatctttggccctctgtgtatcatcatttcttatcactttgaatgagcttgcttgatgttttgactaagaggattgaccacttgttgactatttctgttgtacctttatctcctgagtatgttttgttagataaagaaccactctttgattcatggtgcttcatctagtatcactttgagtcagcttttttaacaaaattcctcttttttaataatcacagactaatatgatgatgaagatccatgttgtccaatactaggactgatgtctcattctgtttcaactagaacttacgtataagacatttagtaaaacggcagaaatttttcactgtgggggcattctcaattttgatactggatttttaattgtaggcttttgaggaggccatagctgagcttgacactctgggagaggaatcctacaaagacagcactctcataatgcagttgctgagggacaatttaaccctttggacctccgatatgcaggtattcacatctctttatgccgtacctcgatattctacaccattcgaataactataaagatcatatcttagtgtgattagtgtttccatcatagaccaatcagatgcatcatataagagacatcaaagaacatgttaaaactgaaataaccgcaaaaccgtgtgtgctgagttattactactctatgtaa

SEQ ID NO: 784 - DNA, 1786 bp, Arabidopsis thaliana; identical to SEQ ID NO: 783
  G528 DNA sequence used for BLAST

SEQ ID NO: 785 - DNA, 990 bp, Arabidopsis thaliana
  G529 cDNA Sequence
gcaaagatgtcttctgattcgtcccgggaagagaatgtgtacttggccaagttagccgagcaagctgagcgttacgaggaaatggttgagttcatggagaaagttgcaaagaccgtggagaccgaggaacttactgttgaagagaggaatctcttgtctgttgcttacaagaacgtgattggtgctaggagagcttcttggaggattatctcttccattgagcagaaggaagatagcaggggcaacagtgatcatgtttcgattatcaaggattacagaggcaagattgaaactgagctcagcaagatttgtgatggcattttgaaccttcttgaggctcatctcattcctgctgcttctttggctgagtccaaagttttttacctgaagatgaagggagattatcatcggtaccttgctgaattcaagactggtgctgagaggaaagaagctgctgagagcactcttgttgcctacaagtctgctcaggatattgctcttgctgatctggctcccactcacccaatcagactggggcttgctcttaacttctctgttttctactatgagattctcaactcatctgatcgtgcgtgtagtctcgcaaagcaggcttttgatgaggcaatctcggagctagacacattgggagaggaatcatacaaggacagtacattgatcatgcagcttctccgtgacaatctcaccctctggacttctgacctcaatgacgaagctggtgatgatatcaaggaagccccgaaagaggtgcagaaagttgatgaacaagcccaaccaccaccttcgcagtgataaaatcagatccatggaatgatttgcagacaaaaagatatatggcttggttctgtgtttttaaacagaaaaaaaccttgtagtttccttaaacatgggctgtagtttccttaaacatggatttgtagtagtaattgtagctgcatgatttggttatcgatggttaaaaaaaaaaaa

SEQ ID NO: 786 - protein, 268 aa, Arabidopsis thaliana
  G529 Amino Acid Sequence
MSSDSSREENVYLAKLAEQAERYEEMVEFMEKVAKTVETEELTVEERNLLSVAYKNVIGARRASWRIISSIEQKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNFSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 787 - DNA, 1395 bp, Arabidopsis thaliana
  G529 DNA sequence used for BLAST
tcactgcgaaggtggtggttgggcttgttcatcaactttctgcacctctttcggggcttccttgatatcatcaccagcttcgtcctggagattagatattagacacaaatgttatgcgaaaaccaacaagaatcttaactgcatgatgcaatcactaagatattgctaacaatgatgagtgtaaagagagacaagtacattgaggtcagaagtccagagggtgagattgtcacggagaagctgcatgatcaatgtactgtccttgtatgattcctctcccaatgtgtctagctccgagattgcctcatcaaaagcctaccaccatgaaaaatcatattagtaactaaacaaaaggtacttgaatcaaactagaatccgaatgtgaaggttgtccaaatttcactagtgtatggaaccattcacaggatctagtttcccaattctgcccatcatcaaaattaactacaaccctatcggtcaggctatggtaagcaatctacaaaccattactagaacatatggaaagtctacccacatggaagtgtaacaagttaactacgtaacacgtttttgccacattatgaacgatagatagaaaaaaagaacctcttatgtgctaagtttaatcaagcaaaacagttggaatataggtttgttagttaatgacagaaagcatagcataaatgaaaaagtaacacagacctgctttgcgagactacacgcacgatcagatgagttgagaatctcatagtagaaaacagagaagttaagagcaagccccagtctgattgggtgagtgggagccagatcagcaagagcaatatcctacataaaaacacaaacaccaatagcatgagacaacatgttatcttagcactctatatggttaagaagaagaaacaagatgataacctgagcagacttgtaggcaacaagagtgctctcagcagcttctttcctctcagcaccagtcttgaattcagcaaggtaccgatgataatctcccttcatcttcaggtaaaaaactttggactcagccaaagaagcagcaggaatgagatgagcctcaagaaggttcaaaatgccatcacaaatcttgctgagctcagtttcaatcttgcctctgtaatccttgataatcgaaacatgatcactgttgcccctgctatcttccttctgctcaatggaagagataatcctccaagaagctctcctagcaccaatcacgttcttgtaagcaacagacaagagattcctctcttcaacagtaagttcctcggtctccacggtctttgcaactttctccatgaactcaaccatttcctcgtaacgctcagcttgctcggctaacttggccaagtacacattctcttcccgggacgaatcagaagacat

SEQ ID NO: 788 - DNA, 1069 bp, Arabidopsis thaliana
  G531 cDNA Sequence
ccacgcgtccgcgacaaatccctaattccaaaatcctctcggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggatattgcacttgctgatttagctcctactcatccgattagactgggacttgctcttaacttctctgtcttctactacgagattctcaactcacctgatcgtgcctgcagtctcgcaaaacaggcttttgatgaggccatttctgagctggatacattaggagaagaatcatacaaagacagtacgttgataatgcaacttctccgtgacaatctgaccctttggaactctgacatcaatgatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtccaaaaaaaaaaaaaaaaaaaaaaaaaaaaaaaaa

SEQ ID NO: 789 - protein, 265 aa, Arabidopsis thaliana
  G531 Amino Acid Sequence
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINDEAGGDEIKEASKHEPEEGKPAETGQ

SEQ ID NO: 790 - DNA, 4340 bp, Arabidopsis thaliana
  G531 Genomic Sequence
caaagaggaggaacatggaacgtttggttttggcatgtggtggagaagctgtgaactctgtcgatgacttgacccctgattgtcttggttgggctggacttgtatatgagcacgttcttggagaggagaagtacacatttgttgagcaagtgaagaatcctcattcatgtactatcctcataaaaggtacaaatgcccaaacttctatctcttgccagctaagttttgaagatcaattttgcttatcttcatatgtgtggtcattgattatctatgattatgatttggttttctttatagggcctaatgaccacactattgctcaaattaaggacgctgtccgtgatggtttaagatcagttaagaataccctagaagatgagtgtgtcgtattagtaagtaccttcttctccacaaagatcaaatccattgctatatcagtgtgattgttttggttttgggcgcatgtggtttattgacatctgtttctttctgtagggagctggagcttttgaagttgcagcaagacaacacttaatcaatgaagtcaagaaaaccgttcaaggggtgagtagaaagcaatattcctttgctccaataccaattcttgtttttttccggttgctaatgtaaattgtgggcaaattgcagcgcgctcaactcggtgttgaagcttttgctaatgcccttctcgtagtgcctaagacgcttgctgaaaatgctgggcttgacactcaagacgttatcatttctctaacggtattattcttgtattttcctcttctgccactatcgattatgctccaagtaaaattatgtttgtgtttatctactgagtttcgatgtatatacagagtgagcatgacaaaggaaacatcgtgggactagacctacaggatggagaacccgtcgaccctcagcttgccggcattttcgacaattactcggtgaaacgccaacttatcaattcagggtatgtgcagaaccaaatggaaatttgtataatggagtcttttaattcagttgcggttgagttcaggttgttaaaacggttgtttggtattgtattgcaggccggtgattgcttcgcagttgctattagtggatgaagtgattcgtgcaggaagaaatatgaggaagcctacttaaaacaagactatcttttgttttcaattttttcttactttccctttcgtgttttgagtattagcatatgaatactatttattttttactcgttatcctttgttgtcttagataattttgaatgtatcttttttttctatcttttgtatcaaacaaacatgatgaatgttttgattgtggtttctagcgaaaacagaacaagataaagatttcagaattttaagaaaatggaaccagatttatgtgtaaacaaacgcaattaaaagtcaaatcaacaacaatgcacggcatactttaattgatttttatttttctagtaacggagtcaaggcccaattaaattatttattttccacgatcattaaagtctttaacgggtcaacaccgttagacacttgtcatactattactgggccttatttttctctttactttctctgaaaatcaaagcccatctcttcttccttttttttcccctaatttctcacttccccctcatttcgcgtctcgacgttggaattcgacaaatccctaattccaaaatcctctcggtaagctacggatctagtctctcttttgctcatagttcgacgaaatcgtctctctgttgctcgttcatgttttcgtttcgttttgtggacttaatcttctctgtgttcgttgttatctggagatctggcaaaatctcgaatgattttgatagattctaggtttctaggtgtatctatcggtataatgttcgttttgtcttgatttgttggtctcgacgatttatctgttgtttcttttgttttgttgggaataatgttgatatagccaagctactgtgatgttgatgaagtttgaaatgaatttttgaaaacaggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggtaaactctttaagtttcaacatctatctatcttattttgctgcttgagaccagtaaaggagctgtcatgatgaatgcttatgtgtgtttttcttctaatgtaggatattgcacttgctgatttagctcctactcatccgattagactgggacttgctcttaacttctctgtcttctactacgagattctcaactcacctgatcgtgcctgcagtctcgcaaaacaggtttgtattttgtcatacgggatgttatgatgcttccagactttgtaacacttattccagcaccaaattgcttaatgatattctctcaattgttttgacaggcttttgatgaggccatttctgagctggatacattaggagaagaatcatacaaagacagtacgttgataatgcaacttctccgtgacaatctgaccctttggaactctgacatcaatgtacacctttgtcttcctccttttgcttttccctataaactcttatatatgcagtctaagcttcttttactcagaaatttctctcaaacgctgattgtgttgctgatttttaggatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtctttggttcctgcttcgttgcttgttagtatttaggaagtgaagaaacaaaactttgaattattgctttccattcaactcgtcataaattatcataatcagtgtattatttacttagttcttattagggtattctgatttttgcttaacgcaacagaatttgtgttaacccatttttaaagaatcttcaatcttgtatcattggtcgggtcagtcggatatatggtccgcttttggtttaagaccggaacaacgaaagccggggatattgagcctttctgatgatgcgcctccgggcggtaatgctattgggacatggattacattctgatcaatagggactaatagtatggatttactttgtacttcagactaggttttttttttttttttttttttttttttttttaaatattattaatcctcatcccaaatgaccttgggccgcaacaaaaacaacatcaaatccagttacaaaattagcaaatcggaaaacatgtcggcaaagaaggaagatcgccgcttgttgatggaagctagcagagagaccggagcattagatccggcgggctcaagccctacagtttcgaggccgcaaccgatgctcgagaaactccgacgaaagagaccggttttcgtcctcgaatcaaccccaccggcgcaccaacccaccacaagactcccagaaagctagtctccccaacaagcacatcgacggcaccggattctgaagaagcaatccgatacactggacggtaacccttccttcccaaaccggtacagatccgaaatcccagagctattgcgtttcaaccggctcgatggatgcaaaattgtgacaaatctaaaggaaggtggctcaaccgaagccttcagatccgtaactcacaaccgccctctaagatcctgaggatctgcagttaaccaccaagcaaacaacactcccaccagatgccctccaacttccgccgtgggcgcagctcaagaccgacggatgagccggaggacccaaagcactc

SEQ ID NO: 791 - DNA, 1116 bp, Arabidopsis thaliana
  G531 DNA sequence used for BLAST
tcactgccctgtctcagctggtttcccctcttccggctcatgttttgacgcctccttgatctcatcaccgcccgcctcatcctaaaaatcagcaacacaatcagcgtttgagagaaatttctgagtaaaagaagcttagactgcatatataagagtttatagggaaaagcaaaaggaggaagacaaaggtgtacattgatgtcagagttccaaagggtcagattgtcacggagaagttgcattatcaacgtactgtctttgtatgattcttctcctaatgtatccagctcagaaatggcctcatcaaaagcctgtcaaaacaattgagagaatatcattaagcaatttggtgctggaataagtgttacaaagtctggaagcatcataacatcccgtatgacaaaatacaaacctgttttgcgagactgcaggcacgatcaggtgagttgagaatctcgtagtagaagacagagaagttaagagcaagtcccagtctaatcggatgagtaggagctaaatcagcaagtgcaatatcctacattagaagaaaaacacacataagcattcatcatgacagctcctttactggtctcaagcagcaaaataagatagatagatgttgaaacttaaagagtttacctgagctgacttgtaagcaaccagagtgctctcagcagcttctttcctctcagctccagtcttaaactcagcaaggtacctgtggtaatctcctttcattttgaggtaaaagactttggactcggccaaagatgcagtgggaacaaggtgagaatccagaagattgagtattccatcacagattttgctgagttcagtttcgatctttcctctgtagtccttgataatggaaacatgatcatcgtttcctctgctttcttccttctgttcaatggaagatatgatcctccaggaagctctcctagcaccaatgacgttcttgtaagcaacagacaagaggtttctctcttcgacagtaagctcatcggtgtcaacagtctttgcaactttctccatgaactcaaccatttcctcataacgttcagcttgctcagctaacttggctaagtacacattctcttcccgagaagacgacat

SEQ ID NO: 792 - DNA, 1100 bp, Arabidopsis thaliana
  G532 cDNA Sequence
gcggccgcgtcgacgaaggaagaagaagaagaagaagaagaaaaaactatggagaatgagagggaaaagcaggtttacttggctaagctctccgagcaaaccgaaagatacgatgaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagtttgtaatgacatcttgtctgtcattgataagcatctcattccatcgtctaacgctgtggagtcaactgtctttttctacaaaatgaaaggagattactatcgctatcttgcggagttcagttctggtgctgaacgcaaggaagctgcagatcagtctcttgaagcatataaggctgctgttgctgctgcagagaatggtttggcacccacacatccagttagacttggcttggcgttgaacttttcagttttctactatgagatcttgaactctcccgaaagcgcatgccaattggctaagcaagcattcgatgatgcaattgctgaacttgacagcctcaacgaggaatcatacaaagacagcactcttattatgcagctacttagagacaatctcaccttgtggacttcagaccttaatgaggaaggagatgagagaaccaaaggtgctgatgagcctcaagatgagaactaaatcctctgtgagaagagaaacgactcttgctgcatcctgaatcttgaagtgaagacagtaagtgtcgttgtttgttactcgaatgtgtaatttttaatctatgtctttcttgatggtgttttccagattcttgaacttttcacaacacaacactgcgttgcgtatcttcaaccctcttatgatgtggttgaattctgttttacgcttagtttgcttcttttgttgttgaattgagccagcaggcatgatttgggtttttgtttatcagaatattaggcgtaaaaaaa

SEQ ID NO: 793 - protein, 254 aa, Arabidopsis thaliana
  G532 Amino Acid Sequence
MENEREKQVYLAKLSEQTERYDEMVEAMKKVAQLDVELTVEERNLVSVGYKNVIGARRASWRILSSIEQKEESKGNDENVKRLKNYRKRVEDELAKVCNDILSVIDKHLIPSSNAVESTVFFYKMKGDYYRYLAEFSSGAERKEAADQSLEAYKAAVAAAENGLAPTHPVRLGLALNFSVFYYEILNSPESACQLAKQAFDDAIAELDSLNEESYKDSTLIMQLLRDNLTLWTSDLNEEGDERTKGADEPQDEN

SEQ ID NO: 794 - DNA, 3912 bp, Arabidopsis thaliana
  G532 Genomic Sequence
ccgttctaggattctagctgttgttatcacttttagttcaggattctgaaaattttctcttttgtttttgattatatagccctgatgggcaacagtttgaaacctgcaaggaagtctccacatatctacgatcacttcttgaatccccaagcaagaaccaacattattacttgcaatctgacaacaagactctaggacaacaaccagtgatagctaacgaatctttactaggtaactctgattccatggactctgagacaatgcagtaccttgagagtggaagaaccagcagtgaggtgtttgaggaagcaaaagccgtagagaatggcaatgaagcagatcgagtgaaaaccagtctgatgcagaaagatgataatgcagattttctgaatggagttgaggacaacgacgatgatatgaagaaaagagatggtaacatggagaatttggcgactctatcgaattcagaaatgacgaaaagcctaccgacaacgactaatgagcttcaacagtatttcagctcacaaatcaaccgagttcagtgaccatttcttttacctggaacaaattgttttctcattctagttcagattttatattttatgcaaactaaaagcgtgttgtagctaactacaggatatagaatttgaaagggccatgtacaaaacatttgacagaaaccaaattttttcttcaaaagaaaatttctttgagtttcaatctgtgattgatttggatttggatttggattggcataaaaaaaatctatgatttggattgtgttatataatatagaaaagaacacaaacccttaaaataatggacaagaggacatgtctttctccgtttatcacggtcagcgtcgttaaccttttacgttattgactagatcggggtttaataagaaacatatattagttttaggttctttctgtgtaaaaactaaacctttgtggctactttataatttataaaacttatgtttctgagttttgttgactaaaaaaagtagatccaacggctgatataataccactatgagaggatcctagggttactactaatctcgaaatcaatcaaatcaaagcatccatttttgattcagacttcagagagacagagaaggaagaagaagaagaagaagaagaaaaaactatggagaatgagagggaaaagcaggtttacttggctaagctctccgagcaaaccgaaagatacgatggtattttccgatttctggatctctattcagaaaatgatttgttcatgtttctgaaaaaatccgatcttttattgctccgatcgaaattgtttttacatttccatagattttctttgtagccctttaccgatttgtatgtttctgggctgttacttgatctggacttttagatgcgacctttaagtaatttcttgtttaatgttgtttagatactctgatcactcttgatcttatcttgatataattttatacttactgttgtcgaatctcttagcatgaaaatgaaatagatctacgtttttggaagcaaattcaaagatcggatattttttttttgttggtgatgatgcagaaatggtggaggcgatgaagaaagttgctcagcttgatgtggagctaactgtggaagagaggaatcttgtatctgtagggtacaagaatgtgattggtgcaaggagagcatcatggagaatactatcttccattgagcagaaggaagagtccaagggaaatgatgaaaatgtcaagaggcttaagaattatcgtaagagagttgaagatgagcttgctaaagtttgtaatgacatcttgtctgtcattgataagcatctcattccatcgtctaacgctgtggagtcaactgtctttttctacaaaatgtgagtgtcatctttattatactctgaccattcatgtgatatttgtgtgactaagaatgagatcatttccgtttgactaaagttaaatgtttaagttattacatagctaccactcttgcttgtgttcttcctgaaatgatgatgattcatgaacttttccttgtttcactgttttgactttacgtgtttttttttctttctatgtaggaaaggagattactatcgctatcttgcggagttcagttctggtgctgaacgcaaggaagctgcagatcagtctcttgaagcatataaggtcctttgatcatgtttatttgttttcttatttttgtgccacccctcttatatttgagctgggaataacctaagacaagtcttgcttttttcgtactgggaatgtaggctgctgttgctgctgcagagaatggtttggcacccacacatccagttagacttggcttggcgttgaacttttcagttttctactatgagatcttgaactctcccgaaaggtttgtttttgtattttggattgaacataatagtggaatctgtggtcattttctgacactatgaaactatgtattgtacagcgcatgccaattggctaagcaagcattcgatgatgcaattgctgaacttgacagcctcaacgaggaatcatacaaagacagcactcttattatgcagctacttagagacaatctcaccttgtggacttcagaccttaatgaggaaggaggtattcttattttcttttgtttccctatctcatgatcaaatggtttccttagaatcaaatgagctgttaagagcgttaccttggagtaaaaatgttgatgtttgggaactcgtaaccattaaccatctgtctatatttgaattaaaccgtcctttatgcatgtattgctatgtagatctttcattttagttttgaaagcctcaacaaaaaacataccaatctaccatctcatagttattggattctagctaatcttgtaaaagttatatgtttgtagcagaaaacattactagtttcttgtttctcttccaaagctttttcactcaccttttttttttcccctcttagatgagagaaccaaaggtgctgatgagcctcaagatgaggtatgaaaagccagttttgttataagttaagctacttactgatttttccattttgcattgacaattagaccactcatggaattactgaatcattgcagaactaaatcctctgtgagaagagaaacgactcttgctgcatcctgaatcttgaagtgaagacagtaagtgtcgttgtttgttactcgaatgtgtaatttttaatctatgtctttcttgatggtgttttccagattcttgaacttttcacaacacaacactgcgttgcgtatcttcaaccctcttatgatgtggttgaattctgttttacgcttagtttgcttcttttgttgttgaattgagccagcaggcatgatttgggtttttgtttatcagaatattaggcgtatcatggtctcaaaattaaaaaccaaaacagacaaagctttattcgaagtttgtaataactaataactccttgcaaaaatcatgaaagtctgaattcaagaggctcttaataatttgcataagtgatcccaaacttcacaacttttcaatttgtggatgtttgccctctttgtggccaaggaatcatcctcaagtgtgtttctctacggtggtttggtccgtaagtgtgtgacataataatggtttggttctcccaacatgaccctcaaaaaggatctctatgctctaaatatgggactcttgtaagttgtaattgtaaccaaatgctatcacaaactctctaactcgtaccaacactcattgtgtctaatccaatcgagagccctcaaagtctaaaacatgttaatcaaactgtgaaccagttaatccttatagaatcagatatctttttgtcaaccatctaaataacatttttgtcacgaattgaccacttccctcgagagatttgtagtgtttcct

SEQ ID NO: 795 - DNA, 1958 bp, Arabidopsis thaliana
  G532 DNA sequence used for BLAST
ttagttctgcaatgattcagtaattccatgagtggtctaattgtcaatgcaaaatggaaaaatcagtaagtagcttaacttataacaaaactggcttttcatacctcatcttgaggctcatcagcacctttggttctctcatctaagaggggaaaaaaaaaaggtgagtgaaaaagctttggaagagaaacaagaaactagtaatgttttctgctacaaacatataacttttacaagattagctagaatccaataactatgagatggtagattggtatgttttttgttgaggctttcaaaactaaaatgaaagatctacatagcaatacatgcataaaggacggtttaattcaaatatagacagatggttaatggttacgagttcccaaacatcaacatttttactccaaggtaacgctcttaacagctcatttgattctaaggaaaccatttgatcatgagatagggaaacaaaagaaaataagaatacctccttcctcattaaggtctgaagtccacaaggtgagattgtctctaagtagctgcataataagagtgctgtctttgtatgattcctcgttgaggctgtcaagttcagcaattgcatcatcgaatgcttgcttagccaattggcatgcgctgtacaatacatagtttcatagtgtcagaaaatgaccacagattccactattatgttcaatccaaaatacaaaaacaaacctttcgggagagttcaagatctcatagtagaaaactgaaaagttcaacgccaagccaagtctaactggatgtgtgggtgccaaaccattctctgcagcagcaacagcagcctacattcccagtacgaaaaaagcaagacttgtcttaggttattcccagctcaaatataagaggggtggcacaaaaataagaaaacaaataaacatgatcaaaggaccttatatgcttcaagagactgatctgcagcttccttgcgttcagcaccagaactgaactccgcaagatagcgatagtaatctcctttcctacatagaaagaaaaaaaaacacgtaaagtcaaaacagtgaaacaaggaaaagttcatgaatcatcatcatttcaggaagaacacaagcaagagtggtagctatgtaataacttaaacatttaactttagtcaaacggaaatgatctcattcttagtcacacaaatatcacatgaatggtcagagtataataaagatgacactcacattttgtagaaaaagacagttgactccacagcgttagacgatggaatgagatgcttatcaatgacagacaagatgtcattacaaactttagcaagctcatcttcaactctcttacgataattcttaagcctcttgacattttcatcatttcccttggactcttccttctgctcaatggaagatagtattctccatgatgctctccttgcaccaatcacattcttgtaccctacagatacaagattcctctcttccacagttagctccacatcaagctgagcaactttcttcatcgcctccaccatttctgcatcatcaccaacaaaaaaaaaatatccgatctttgaatttgcttccaaaaacgtagatctatttcattttcatgctaagagattcgacaacagtaagtataaaattatatcaagataagatcaagagtgatcagagtatctaaacaacattaaacaagaaattacttaaaggtcgcatctaaaagtccagatcaagtaacagcccagaaacatacaaatcggtaaagggctacaaagaaaatctatggaaatgtaaaaacaatttcgatcggagcaataaaagatcggattttttcagaaacatgaacaaatcattttctgaatagagatccagaaatcggaaaataccatcgtatctttcggtttgctcggagagcttagccaagtaaacctgcttttccctctcattctccat

SEQ ID NO: 796 - DNA, 1023 bp, Arabidopsis thaliana
  G533 cDNA Sequence
ccgatttcaaaattttccggtgaaatcgaaaaaaaaagcgagatcttcttctctaatggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcgggcgcgtataagaacgtgattggatctcttcgcgcggcatggagaatcgtgtcttcgcttgagcaaaaggaagagagcaggaagaacgaagaacacgtgtcgcttgttaaggattacagatctaaagttgagactgagctttcttcgatcttttctgggattctcaggttacttgattcgcatctaattccttcagctactgccagggagtctaaggttttttacctgaagatgaaaggagattatcatcgttatttggctgagtttaaatctggtgatgagaggaaaactgctgctgaagatgctatgatcgcttacaaagctgctcaggacgttgcagttgctgatctagcacctacacatccgatcaggcttggtttggctcttaacttctcagtgttttactacgagattctcaactcttcagagaaagcttgtagcatggcgaaacaggcttttgaagaagccattgctgagctggacacattgggagaggagtcatacaaggacagtactctcatcatgcagttgctaagggacaatctaaccctttggacctccgatatgcaggagcagatggatgaggcctgaaggtctaatggaagaaaagacggttatgtaatgtacctgcaaccgtaaccgaaaatctgagttcaacctcctttgctgtaaaacttgtcgaaaagaaaagtttgtttttttatgacagattatgtgcacagctttggtgttatctgctgctctgtatcaactctgtttttgtttggtaatttatcctcatctttgcttaaaagaaaaaaaaaaaaaaaaaa

SEQ ID NO: 797 - protein, 248 aa, Arabidopsis thaliana
  G533 Amino Acid Sequence
MATTLSRDQYVYMAKLAEQAERYEEMVQFMEQLVSGATPAGELTVEERNLLSGAYKNVIGSLRAAWRIVSSLEQKEESRKNEEHVSLVKDYRSKVETELSSIFSGILRLLDSHLIPSATARESKVFYLKMKGDYHRYLAEFKSGDERKTAAEDAMIAYKAAQDVAVADLAPTHPIRLGLALNFSVFYYEILNSSEKACSMAKQAFEEAIAELDTLGEESYKDSTLIMQLLRDNLTLWTSDMQEQMDEA

SEQ ID NO: 798 - DNA, 1710 bp, Arabidopsis thaliana
  G533 Genomic Sequence
atggcgacgaccttaagcagagatcaatatgtctacatggcgaagctcgccgagcaagccgagcgttacgaagagatggttcaattcatggaacagctcgtaagtggagctacaccggccggtgagctgaccgtagaagagaggaatcttctctcggtcgcgtataagaacgtgattggatcgcttcgtgcggcatggagaatcgtgtcttcgattgagcaaaaggaagagagcaggaagaacgaagaacacgtgtcgcttgttaaggattacagatctaaagttgagactgagctttcttcgatctgttctgggattctcaggttacttgattcgcatctaattccttcagctactgccagtgagtctaaggttttttacctgaagatgaaaggagattatcatcgttatttggctgagtttaaatctggtgatgagaggaaaactgctgctgaagatactatgatcgcttacaaagctgctcaggtatatctttgattccctaaatccttgaatcgatcctgttgtggagctaaaaccctatttctgagattacttcaattagctaatctgtaatcagttgtctcataataagtaaattggtctcgaatctagctattgtattgatcctatcgttagaagtagtcaacttttactatttgggcttaagatcaattgcttccctaatatgtcttagtaatatataattgttctgaaaatatgtatttttgctcattcgtgggtttttgtattgaaggacgttgcagttgctgatctagcacctacacatccgatcaggcttggtttggctcttaacttctcagtgttttactacgagattctcaactcttcagagaaagcttgtagcatggcgaaacaggtactctttcttcatccactatactgcatgtttgtttcaagtagagtttctctgtctgatcatcattgtcttaagtttggttacggagagtgtaatttgcattttgagttactaacttgaccacttgttttactattcctattggccccatcttgtattcattgtgttgggttgatttgaaggaattttgaaacctttaccagaaatagacaagttgtttataaaaagtaactctttcttctttctgaacggacccacttctttttaataaacagagattctaaagaaaaagacattctgcaaagtcctcttttgatataacttttttgactaacgcttcacattaaccaaattattccttttgtcagtagaatctcttaaaatgacaagactttagaaccacaatatctcatacattatgcatacgagattgtgtagaatctgatcggggttttggtgcatattgaatccggaacatctcatgcatcacatatacaagattctataagactattaaagctcatcttatcatcgcatttctaacttgttcttgttggattcatcacctctaggcttttgaagaagccattgctgagctggacacattgggagaggagtcatacaaggacagtactctcatcatgcagttgctaagggacaatctaaccctttggacctccgatatgcaggtttgcccaattctatactttcatattcaattgcatcatcagaaactcgcatattgatagtcttataagattattcggataataacaccccaaaactcaatgatcgactgctttattcaggagcagatggatgaggcctga

SEQ ID NO: 799 - DNA, 1738 bp, Arabidopsis thaliana
  G533 DNA sequence used for BLAST
cataaccgtcttttcttccattagaccttcaggcctcatccatctgctcctgaataaagcagtcgatcattgagttttggggtgttattatccgaataatcttataagactatcaatatgcgagtttctgatgatgcaattgaatatgaaagtatagaattgggcaaacctgcatatcggaggtccaaagggttagattgtcccttagcaactgcatgatgagagtactgtccttgtatgactcctctcccaatgtgtccagctcagcaatggcttcttcaaaagcctagaggtgatgaatccaacaagaacaagttagaaatgcgatgataagatgagctttaatagtcttatagaatcttgtatatgtgatgcatgagatgttccggattcaatatgcaccaaaaccccgatcagattctacacaatctcgtatgcataatgtatgagatattgtggttctaaagtcttgtcattttaagagattctactgacaaaaggaataatttggttaatgtgaagcgttagtcaaaaaagttatatcaaaagaggactttgcagaatgtctttttctttagaatctctgtttattaaaaagaagtgggtccgttcagaaagaagaaagagttactttttataaacaacttgtctatttctggtaaaggtttcaaaattccttcaaatcaacccaacacaatgaatacaagatggggccaataggaatagtaaaacaagtggtcaagttagtaactcaaaatgcaaattacactctccctaaccaaacttaagacaatgatgatcagacagagaaactctacttgaaacaaacatgcagtatagtggatgaagaaagagtacctgtttcgccatgctacaagctttctctgaagagttgagaatctcgtagtaaaacactgagaagttaagagccaaaccaagcctgatcggatgtgtaggtgctagatcagcaactgcaacgtccttcaatacaaaaacccacgaatgagcaaaaatacatattttcagaacaattatatattactaagacatattagggaagcaattgatcttaagcccaaatagtaaaagttgactacttctaacgataggatcaatacaatagctagattcgagaccaatttacttattatgagacaactgattacagattagctaattgaagtaatctcagaaatagggttttagctccacaacaggatcgattcaaggatttagggaatcaaagatatacctgagcagctttgtaagcgatcatagtatcttcagcagcagttttcctctcatcaccagatttaaactcagccaaataacgatgataatctcctttcatcttcaggtaaaaaaccttagactcactggcagtagctgaaggaattagatgcgaatcaagtaacctgagaatcccagaacagatcgaagaaagctcagtctcaactttagatctgtaatccttaacaagcgacacgtgttcttcgttcttcctgctctcttccttttgctcaatcgaagacacgattctccatgccgcacgaagagatccaatcacgttcttatacgcgaccgagagaagattcctctcttctacggtcagctcaccggccggtgtagctccacttacgagctgttccatgaattgaaccatctcttcgtaacgctcggcttgctcggcgagcttcgccatgtagacatattgatctctgcttaaggtcgtcgccat

SEQ ID NO: 800 - DNA, 1126 bp, Arabidopsis thaliana
  G535 cDNA Sequence
aaatctctctcaatctctctcagatctgaatccatccatcaccgatctctaatggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggacaagagaggaaagatgctgctgaacatactctcaccgcttacaaagctgctcaggatattgctaatgctgaattggctccaacgcatccgattcgtcttggtttggctttgaatttctctgtgttttactatgagattcttaattctccagatcgtgcttgtaatctcgctaagcaggcgtttgatgaagccattgctgagttagatactcttggagaggagtcatacaaggatagtaccttgatcatgcagcttcttcgtgacaatcttactctctggacttctgacatgcaggacgaaagtccggaggagattaaagaagcagcagcaccaaagcctgctgaagaacagaaggagatctaagtttgtggtttcttttttcagtattcttaagttatgcaattataattatgtttctgcttggtgtttattttctaatctttcctttgctatccccgaagcttctaaggccgtctaattcttgtcctttgtttgcttttctcaatcgtggatgctactggatttctgttttgttttacttcttctcttgattgattgcatttcccggcttatgccttgtacttgaaactcagttttctctcttattaatgatttgccattcaccaaaaaaaaa

SEQ ID NO: 801 - protein, 267 aa, Arabidopsis thaliana
  G535 Amino Acid Sequence
MAAPPASSSAREEFVYLAKLAEQAERYEEMVEFMEKVAEAVDKDELTVEERNLLSVAYKNVIGARRASWRIISSIEQKEESRGNDDHVTTIRDYRSKIESELSKICDGILKLLDTRLVPASANGDSKVFYLKMKGDYHRYLAEFKTGQERKDAAEHTLTAYKAAQDIANAELAPTHPIRLGLALNFSVFYYEILNSPDRACNLAKQAFDEAIAELDTLGEESYKDSTLIMQLLRDNLTLWTSDMQDESPEEIKEAAAPKPAEEQKEI

SEQ ID NO: 802 - DNA, 4429 bp, Arabidopsis thaliana
  G535 Genomic Sequence
tgagttttcaccaatgcaatgatccttaggagtacttccctccaatgaatattatctttgtttattgcttcttgggcatgcttatcaatcgttttatttttctgtagtctagactctaactcagctcgacgagtcatacaagtaatgtgatcatggctgcctttgtgttctttgagtcgctttgaaagatttctccaatcattgtacccgctagttgccaagtaaccaccttttttgtcatgtctcaacaacttacaacaaaaacaaaagactttaatctaatgcttttgagtaaatcaaccatcttctatcttgtttctccccattcctcatttctcttatgtaaaatgtttgagaaaaatgcctaccaatactatctttacgaaaccggtaattagttgataaccttgtcgctagacccttttcaactaataaatctctgaatctcatattcatgtcatcccaatttactggatcggaaatattggaaggaagttcttctttctgcccacttttcttctcttcatgaacaacttcatcttgatctttgttatcaaactcattctcatccacttcattcgtcatccaaactgtccacattattgttgttatcaagcatctgcttggaggagccaatgtaggcatgtgctctctcttcttgttatcaagcatctgcttgtgatatttttgtacaattaagctaacataactttaacaaaaaaaatctgtaataataagtttatatgtacaatctaattccaacaaatcaaatactaaactaaatatcattgatcaactaatttttttatttcctaagaacatatctctttaaaagaattgtttgaagtttcttccattagaataagtcttgtgaaaattttatttattacatcattaagtaaaacttcttttaaattaataggttaaacagtctatatatatttagtttttttttttgaaaaataaaataaattgcataaaataaattggcactaattttaaaataaaacgttctaaagatattttttatacaatatataataattaataacctaacaatttctttcttttttaacaaaacaatttcaaaattcaacttaaaaaaaaaattgctcaatcaacagaaattacaaaatgccaatatggacgtaaaaggtccattaaggaatcaaaatacaacaaagtaactttttccacataaaaataaactaagggcatctccaacgcacagatacagtatgagtttctcaattctatttttttaatcagttaataataaatatattatttatttaaattttatattataaagacaaaatctgaccaatcataaataacaaggggttgagttgggtttctcatagtttctcatatgagaaacgtttctctttctttctccacctttttcattactttttatttttttaatctccagatactcattaaaaaactgctgttggagatgacctaaaaaccgacccaaaaagtatcagaaaattaccgtgttcaaaattaatccaacggtcctccttccatctcctttcgcaatcgtcgctccccactcaaacaaaaaccaaaaaaaacaaaactatcttttaaaccccaacaaaaaaaaaattgaaattcgaaaacagaacaaaaaaaaaaatctctctcaatctctctcagatctgaatccatccatcaccgatctctaatggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggtcaagagaggaaagatgctgctgaacatactctcaccgcttacaaagctgctcaggtttattctccgatctggaattttgttggatctcatttctaggttaaatcatgatttgtgtgaatctgtgtttcttttgtttgtttgtaggatattgctaatgctgaattggctccaacgcatccgattcgtcttggtttggctttgaatttctctgtgttttactatgagattcttaattctccagatcgtgcttgtaatctcgctaagcaggtgatgagaaagtttctgatctatttgggatttgagtcattgtgttggtactactctatgtgtattgatattgagatataacaggcgtttgatgaagccattgctgagttagatactcttggagaggagtcatacaaggatagtaccttgatcatgcagcttcttcgtgacaatcttactctctggacttctgacatgcaggtaaacgatcgaaacgaaaccgttctttgcttcatcgaaactgctgataatggttatgatagaatagttttggaattgtccaccaacatagttcattgctgataatggatatgatagataggcttagtggctcatgatgctggaattgtgcacacacattgttcataagctttgaatcagatggtttagttttgcattatgtatgataatactctcatgagcttcttggtcttgatctctgattctgttgtgttaatttcgacgattaatcaggacgaaagtccggaggagattaaagaagcagcagcaccaaagcctgctgaagaacagaaggagatctaagtttgtggtttcttttttcagtattcttaagttatgcaattataattatgtttctgcttggtgtttattttctaatctttcctttgctatccccgaagcttctaaggccgtctaattcttgtcctttgtttgcttttctcaatcgtggatgctactggatttctgttttgttttacttcttctcttgattgattgcatttcccggcttatgccttgtacttgaaactcagttttctctcttattaatgatttgccattcacctggttatgcgtttttgtatacatgtgactgcgtttgcaattgtgttttctgagtttgcttaggttatgcacacacaatttacgctgtttgagaatgagcgcttgctaatactgatacagattattacaggaaacactgacctcaaaatttgcgtgaatttcgatgagatttgcgtaggaataacaagtgttgggcatataggtttgaatcaaatgggacttaccaaagtttgtatcaacctcgttcaccagttattgttttgcagacctcaaccaaaagttaacatgaacgaggtcaatacctctcaaaagctgattaattgatagcatcactcatagtaaggtagagattaatgttcaagaaaacgttaggcgttaattgggcggtaacccaatgcaacgcttcatcgggtctaaacagttttaggcggttaaagcgtttatagtataaaatattataaatatgttattatatgtaaaagttatttaaaacataaattaaaaaataaaaatcttaaatttacaaaacaaaaaatagataaaacgtacattaattcatatcaaacaacatttgaacattaaactatatatatgaagacaaaatttaacaaatttgaatttgagtaattaaaatttggaaaaaaatattaaaacgaagcatatataatcttaggcggtcgaaactgtcgtttaggcgtcatgtgaaaacctaacattcgatctctacgttttcacgtccgcgggttactctagaataatttgaaatgagtttatagatccatgtagaacccaaataagtttgtgatcttcctaaatgaatggcacatgaaaatatgccagacaacaatttttttgacagaagatcttaagctcataagatgtaaacttcaacgagccatctcaagtaaccatagatagctgtcatggattgaacattaatgtaaattatttatttgcaataacatttttaatatcaaatttttatgattgtgtccctaatttgaataccgtctagatccgccaataagcaagacttggtaaggttgacttgaagaaattttacgagatttctttccactattattctttacattcttgttataatggtttttctacctttttttagtttacttgtgatttttgacaaataaagctgttactttggctaaagattccattgattagttgttttttttttactttccttgttccttttttttt

SEQ ID NO: 803 - DNA, 1251 bp, Arabidopsis thaliana
  G535 DNA sequence used for BLAST
atggcggcaccaccagcatcatcctcggcgagggaagagttcgtgtacctcgcaaagctcgcagagcaagcggaacgttacgaagaaatggttgaattcatggaaaaagtcgctgaagccgttgacaaagacgaactcaccgtcgaagaacgtaatctcctctccgtcgcttacaaaaacgtaatcggcgctcgtcgtgcttcctggagaatcatctcttccattgaacaaaaagaagagagtcgtggtaacgatgaccatgtgaccacgatccgtgattacagaagcaagatcgaatctgagttatcgaaaatctgtgacggtattcttaagcttcttgatactagacttgttcctgcttctgctaatggagattctaaggttttttaccttaagatgaagggagattatcataggtatttggctgagtttaagactggtcaagagaggaaagatgctgctgaacatactctcaccgcttacaaagctgctcaggtttattctccgatctggaattttgttggatctcatttctaggttaaatcatgatttgtgtgaatctgtgtttcttttgtttgtttgtaggatattgctaatgctgaattggctccaacgcatccgattcgtcttggtttggctttgaatttctctgtgttttactatgagattcttaattctccagatcgtgcttgtaatctcgctaagcaggtgatgagaaagtttctgatctatttgggatttgagtcattgtgttggtactactctatgtgtattgatattgagatataacaggcgtttgatgaagccattgctgagttagatactcttggagaggagtcatacaaggatagtaccttgatcatgcagcttcttcgtgacaatcttactctctggacttctgacatgcaggtaaacgatcgaaacgaaaccgttctttgcttcatcgaaactgctgataatggttatgatagaatagttttggaattgtccaccaacatagttcattgctgataatggatatgatagataggcttagtggctcatgatgctggaattgtgcacacacattgttcataagctttgaatcagatggtttagttttgcattatgtatgataatactctcatgagcttcttggtcttgatctctgattctgttgtgttaatttcgacgattaatcaggacgaaagtccggaggagattaaagaagcagcagcaccaaagcctgctgaagaacagaaggagatctaa

SEQ ID NO: 804 - DNA, 768 bp, Arabidopsis thaliana; identical to SEQ ID NO: 67
  G536 cDNA Sequence

SEQ ID NO: 805 - protein, 255 aa, Arabidopsis thaliana
  G536 Amino Acid Sequence
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 806 - DNA, 2700 bp, Arabidopsis thaliana
  G536 Genomic Sequence
tctagaatttgctttcctaggacaaatataggtactgaattattaaagaacatattttttggtaagatataagtgagtttttatataattttgatgattttaggtaagttgatgtgatttactgtaaagtcttttcaaattctatctaaaactatgagatttagatttctgtatttttaactaaagaagtcttttcaaatcctttcaaatccttcaaaattaataagaatcaaatccactaactatttccagtaacagtaaaaaggttgatttttaaatttttaatttaataacactcaattccatttaaaaatttaaaatccataattaaataacataaaatttataaattttacataaattattagattgaatacaccgcttctaaatatacacaatgtaaaaagtctgtttaagatcaattatagatttaacttaaatctaaaggcccataataccgtcctgtacatcatatagttatctcaagttgtaatactgtaatacccgttgggcccagtggcccatttatcagatttcaaataacagatctcaacactagcatggctacacacgtgtcagattcaatgcatcagtcatatcttcagcatccaacacttgtcaaccttccattggatctcttaactctacgcctcgaaaacagttttaatttatttatcattccatttctcattgtatcttcatcagtctcttcttattccattttttcaaaccacttgaaaaattcgaatcagatcttctctacaatcgaaaaaaaagaaaggtaaatctctctctctctaatcatcgttcgtttcgtagtttcttcttctacgtgtagatctgatctttgattgtatgtttctggagatctcgatgtcatcgattctctgttcttatcactgattcagtgtgtttgatatctaaatccgatttgtgtgtaggatgttaaaatttaggtttcggttttgtttctgcttttgaacgattttgctctagattcgttatccgtgaagaacatagacgagtatgtagatcttacttcggattcgcgttgaagaattttctctagattcgtcacctatgaagaagattcattgtgttcttaatctagatgattaggttattgtttcgactcatttgtttatgcctcttttgtgtatgttcttaatcggtgaagaaatgtatcaatgtgtgtatgttttgggttctgattttgtaggatttgctctacattgttgaatcgaagatgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgtaagtcattctttacaacgtttttgaatgttgttttcttttgtgggtatgattgattttgttgttgtgataatgcaggacattgccactgctgagttagctcctactcacccgataaggcttggtcttgcactcaacttctctgtgttttactatgaaatcctcaactcgcctgatcgtgcttgcagcctcgcaaagcaggtttgtgtagtacacctgattttcactttttgcttcgtgtgttattattatctcagtgaatgaaacagctattttgggtttgtgcaggcgtttgatgatgcaatcgctgagttagatacattgggtgaggaatcatacaaggacagtacactgattatgcagcttcttagagacaatctcactctctggacttcagatatgactgtaagtattaacaacacaatatacgttgatcactaagttatgttgttgacatgatggtttcttttttggtgaataggacgaagcaggagatgagattaaggaggcatcaaagcccgatggtgccgagtaaacccgaagaagaggaagagtcattttataatggtagaaaactttcatgtgataatctgagtgagggatagctcaggattcttataagagacacagttttattgttgtttgtttgttttgaaactacttgcgatttatcattcctcctttagcttcctcaatatttcctattctcctttctaatgaaatcaaaacttggttatttctgatatggtagttgtctttattttctatttttttggttattgatttgatcaactaaaaaagtgtgataactttctcaaattgattaattaatgtacgaaaacacaagctgcaaatggatcacttccatgacattatactttgatataatatattacaagaaataaaaggtaactaaagtagagaaaacaagaaaccatatttataacaaaatatttcatttcaaacaatggtaaaagatc

SEQ ID NO: 807 - DNA, 771 bp, Arabidopsis thaliana
  G536 DNA sequence used for BLAST
atgttgctattatcaaggattacagaggaaagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgtaagtcattctttacaacgtttttgaatgttgttttcttttgtgggtatgattgattttgttgttgtgataatgcaggacattgccactgctgagttagctcctactcacccgataaggcttggtcttgcactcaacttctctgtgttttactatgaaatcctcaactcgcctgatcgtgcttgcagcctcgcaaagcaggtttgtgtagtacacctgattttcactttttgcttcgtgtgttattattatctcagtgaatgaaacagctattttgggtttgtgcaggcgtttgatgatgcaatcgctgagttagatacattgggtgaggaatcatacaaggacagtacactgattatgcagcttcttagagacaatctcactctctggacttcagatatgactgtaagtattaacaacacaatatacgttgatcactaagttatgttgttgacatgatggtttcttttttggtgaataggacgaagcaggagatgagattaaggaggcatcaaagcccgatggtgccgagtaa

SEQ ID NO: 808 - DNA, 1170 bp, Arabidopsis thaliana
  G537 cDNA Sequence
atggcgtctgggcgtgaagagctcgtatacatggctaagctcgcggagcaagcggagaggtacgaagagatggtagagtttatggagaaagtctccgccgccgttgatggcgatgaactcaccgtagaagagcgaaatcttctctccgtcgcttataagaatgtgattggtgctcgccgtgcctcgtggcgtatcatttcatcgatcgagcagaaggaagagagccgtggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggtttgattccgaatctcagatctagtttatttgagtctagtgtgtgatccgtggatggtggtttgttagatttccagtataatgagacttaaattagggatttgtgtattctcgaataagatcttgagattgtctaggttttgagcttatagtctctatgtgtaattatctgtgcaggatattgctaatgcagagcttgctccaacacacccaattcgtcttggtcttgcattgaacttctctgtgttctattacgagatcctcaattctcctgatcgtgcctgtaacctcgccaaacaggtacttcaatctactcatctctcaattatgataatgtgattggacgtggtttaacacttgacctcattggacataaatgtgactggttttgttgttgttatgtatcgtcaaggcctttgatgaggcgattgcagagttggacactcttggtgaagagtcatacaaagacagtaccttgatcatgcagcttcttcgtgacaatctcactctctggacatctgatatgcaggtttgtggatataatccccgcacctttgtcctttctttgtttctgttatggatgattcgcattccattgactaaattctgtaacggtggggattatattaggatgatgctgcggatgagatcaaggaagcagcagcgccaaaaccgaccgaggaacagcagtga

SEQ ID NO: 809 - protein, 374 aa, Arabidopsis thaliana
  G537 Amino Acid Sequence
MASGREELVYMAKLAEQAERYEEMVEFMEKVSAAVDGDELTVEERNLLSVAYKNVIGARRASWRIISSIEQKEESRGNDDHVTAIREYRSKIETELSGICDGILKLLDSRLIPAAASGDSKVFYLKMKGDYHRYLAEFKTGQERKDAAEHTLAAYKSAQVFRISDLVYLSLVCDPWMVVCISSIMRLKLGICVFSNKILRLSRFAYSLYVLSVQDIANAELAPTHPIRLGLALNFSVFYYEILNSPDRACNLAKQVLQSTHLSIMIMLDVVHLTSLDINVTGFVVVMYRQGLGDCRVGHSWRVIQRQYLDHAASSQSHSLDIYAGLWISPHLCPFFVSVMDDSHSIDILRWGLYDDAADEIKEAAAPKPTEEQQ

SEQ ID NO: 810 - DNA, 2250 bp, Arabidopsis thaliana
  G537 Genomic Sequence
ggatcccctgacatgctcacaacacacatgtgtccctctgagctgtctccatttttgttaacccaacttgcttccattattgtatcaatctcacaactccaatttcttttcacaattagtaaataactatattaacaaatctacaaaaaactagcccctattttaaccactagacccaaaattttataattccttaaggtgcctatactaatagtagcaaaatcacattaccaattattttgttaattgaccaaattttatccaataatcacattaccaattttcctaaaagtgtatttatgttgttcttaatttgaggtgaaaaaaaatccccctttaaaaagcaggaccggccacaaatccaacggcccagattagatcttggttccaaatttcactcttttcctctaaaacgcatttatcactttccctcattaaacacaaaaactcattcatcgtcctctctcgcttgacctacaacaccccattctctaatcgaaaccggttctctctttttgatcagatctcagatctttccctctttgattcttcttccttagatcgattctctctagaaacaacaatggcgtctgggcgtgaagagctcgtatacatggctaagctcgcggagcaagcggagaggtacgaagagatggtagagtttatggagaaagtctccgccgccgttgatggcgatgaactcaccgtagaagagcgaaatcttctctccgtcgcttataagaatgtgattggtgctcgccgtgcctcgtggcgtatcatttcatcgatcgagcagaaggaagagagccgtggtaacgatgaccacgtcacggcgatccgtgaatataggtctaagatcgagacggaactctccggaatctgcgacggaatccttaagttgcttgactctagactcatccctgccgctgcttctggtgattccaaggtcttttaccttaagatgaagggagattatcacaggtacttggctgagtttaagactggtcaagagaggaaagacgccgccgaacatacactcgccgcttacaaatctgctcaggtttgattccgaatctcagatctagtttatttgagtctagtgtgtgatccgtggatggtggtttgttagatttccagtataatgagacttaaattagggatttgtgtattctcgaataagatcttgagattgtctaggttttgagcttatagtctctatgtgtaattatctgtgcaggatattgctaatgcagagcttgctccaacacacccaattcgtcttggtcttgcattgaacttctctgtgttctattacgagatcctcaattctcctgatcgtgcctgtaacctcgccaaacaggtacttcaatctactcatctctcaattatgataatgtgattggacgtggtttaacacttgacctcattggacataaatgtgactggttttgttgttgttatgtatcgtcaaggcctttgatgaggcgattgcagagttggacactcttggtgaagagtcatacaaagacagtaccttgatcatgcagcttcttcgtgacaatctcactctctggacatctgatatgcaggtttgtggatataatccccgcacctttgtcctttctttgtttctgttatggatgattcgcattccattgactaaattctgtaacggtggggattatattaggatgatgctgcggatgagatcaaggaagcagcagcgccaaaaccgaccgaggaacagcagtgatcttttgagtgaaactgctagttttcttctagggtttggaatttcttctctttctcgtccatatgtttttcttaatccatctaagaggtcgctcttgccatttcgctcatcttcaaaagcttattcattcatcacatttgtggcaagtctgaaccatcaatcatctttttatctctttttaatttattttctcttttcttatttctttgttgttatcgatttcaatgtctgtgtaatcgaaacttgctttcttttctcatcaatttgaagatcataaagtctcttgtctcttatcttgttgcgtagattgattgtttatcaatttttaattttaaaagcggactagtttattggactgcgtaaagccaattactttacctggtctgaaatcaatcatcaatttgattatataaaaataaaaatacatttcaaaagaactatttaagcaatagacactcgttagtcatttgacactttacaggtttaaattaatgatc

SEQ ID NO: 811 - DNA, 1170 bp, Arabidopsis thaliana
  G537 DNA sequence used for BLAST
tcactgctgttcctcggtcggttttggcgctgctgcttccttgatctcatccgcagcatcatcctaatataatccccaccgttacagaatttagtcaatggaatgcgaatcatccataacagaaacaaagaaagaacaaaggtgcggggattatatgaacaaacctgcatatcagatgtccagagagtgagattgtcacgaagaagctgcatgatcaaggtactgtctttgtatgactcttcaccaagagtgtccaactctgcaatcgcctcatcaaaggccttgacgatacataacaacaacaaaaccagtcaaatttatgtccaatgaggtcaagtgttaaaccaagtccaatcacattatcataattgaaagatgagtagattgaaatacctgtttggcgaggttacaggcacgatcaggagaattgaggatctcgtaatagaacacagagaagttcaatgcaagaccaagacgaattgggtgtgttggagcaagctctgcattagcaatatcctgcacagataattacacatagagactataagctcaaaacctagacaatctcaagatcttattcgagaatacacaaatccctaatttaagtctcattatactggaaatctaacaaaccaccatccacggatcacacactagactcaaataaactagatctgagattcggaatcaaacctgagcagatttgtaagcggcgagtgtatgttcggcggcgtctttcctctcttgaccagtcttaaactcagccaagtacctgtgataatctcccttcatcttaaggtaaaagaccttggaatcaccagaagcagcggcagggatgagtctagagtcaagcaacttaaggattccgtcgcagattccggagagttccgtctcgatcttagacctatattcacggatcgccgtgacgtggtcatcgttaccacggctctcttccttctgctcgatcgatgaaatgatacgccacgaggcacggcgagcaccaatcacattcttataagcgacggagagaagatttcgctcttctacggtgagttcatcgccatcaacggcggcggagactttctccataaactctaccatctcttcgtacctctccgcttgctccgcgagcttagccatgtatacgaactcttcacgcccagacgccat

SEQ ID NO: 812 - DNA, 890 bp, Arabidopsis thaliana; identical to SEQ ID NO: 12
  G545 cDNA Sequence

SEQ ID NO: 813 - protein, 227 aa, Arabidopsis thaliana
  G545 Amino Acid Sequence
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 814 - DNA, 684 bp, Arabidopsis thaliana
  G545 DNA sequence used for BLAST
ttaaagttgaagtttgaccggaaagtcaaaccgaggcttcttcgccggcatagggctcatgacttcgtcgtctccgttgaccatcgagaattcagggatcggagggatgttgaggtcaaacccacggtggctactgctaacgtggctagtggaccccgcaccttcggagttggacacgctactagtgttgatgttgttgtttccttcgtagtggcaccgcttgtgtccgccgagagcttgaccggaaggaaaagacttgttacagatggtgcaaacgtgtgatttcccacttccagtagtcacggcggatgtggttgtcgccgacgaggttgaatgatcatctcctccgccggagagagtctgtgataagttcttacggtggcttgccttgtgaccaccgagagcttggtaagaagagaacgtcttgtcgcagacgctacacttgtagctcaacttctccaccgccggaggaggaggaggctgacggttgtcgcgagcgagaagcatgaggcaaaaagctagatactcttcctcagtgaggttttggtggtggaaatcggatcttgatctcttagatcgcttaccctttgtccagtgctcgactccatggaagactgaagaatcttcgaacaaaggaggaatcggagaagctaatcttggtgatgtaagagcctcgagcgccat

SEQ ID NO: 815 - DNA, 1529 bp, Arabidopsis thaliana
  G553 cDNA Sequence
ttgatcggaatattccttttagaatgccaagattcattcttcatctctcgagctcctcatgaatttcttctctgcttatcaatggagatgatgagctcttcttcttctactactcaagttgtatcattcagagacatggggatgtatgaaccatttcaacagttatctggttgggagagtcctttcaaatcagatatcaacaatattactagtaatcagaataacaatcagagttcttcaacaacacttgaggttgatgctagaccagaagcagatgataacaatagagtgaattatacttctgtgtataataactctcttgaagcagaaccgtcgagtaataatgatcaggacgaagaccggatcaatgataagatgaaacggcgtttggctcagaaccgagaagctgctcgcaaaagtcgtttgagaaagaaggcccatgttcaacagttagaagaaagccggttgaagttgtcacagctcgagcaggaacttgtaagagctaggcagcagggattatgcgtacgcaattcttcagatactagttatctaggaccagctgggaatatgaactcaggtattgctgcatttgagatggaatacacacactggctagaagagcaaaacaggagagttagtgagattcgaacagcgctccaagctcatataggtgacattgagctcaaaatgttggtagatagttgcttgaaccactacgcaaatctcttccgcatgaaagctgatgctgcaaaggctgatgtgttcttcttgatgtcgggaatgtggcgaacttcaactgaacgcttcttccaatggattggaggtttccgcccatccgagcttttaaatgttgtgatgccatacgttgagcccttaaccgatcagcaactgttggaggtgcgtaacctgcaacagtcgtctcagcaagcagaggaggctctctctcaaggcttagataaacttcagcagggtttggtcgaaagcatagcaattcagataaaagttgttgagtctgtgaatcacggggctccaatggcttcagccatggagaatcttcaagcattggagagttttgtgaaccaggcggatcatctgagacaacagaccctgcagcaaatgagtaagatattgacgacaagacaggctgctcgagggttgctcgctctaggagaatacttccacaggctgcgtgctcttagttctctctgggcagctcgtccacgagaacacacttgacaagttaggaggcaaacaaaacaaagagaaagaagcacaaggcagatgatgttagctatagggacttgctttatctctcagaaagtgttggctgatattttctccattagagagcatcatcttcctcattgatgattttgtttacttgaaaggaataagagatgtgtaaatttgggtggaaaacatgtaatgtctttgatgcattaggctctttatttgtaaaatatatagggtttgttgtcactcatctcctcgtatatgaaaatttgagcccacaatcaaattttttgtct

SEQ ID NO: 816 - protein, 384 aa, Arabidopsis thaliana
  G553 Amino Acid Sequence
MEMMSSSSSTTQVVSFRDMGMYEPFQQLSGWESPFKSDINNITSNQNNNQSSSTTLEVDARPEADDNNRVNYTSVYNNSLEAEPSSNNDQDEDRINDKMKRRLAQNREAARKSRLRKKAHVQQLEESRLKLSQLEQELVRARQQGLCVRNSSDTSYLGPAGNMNSGIAAFEMEYTHWLEEQNRRVSEIRTALQAHIGDIELKMLVDSCLNHYANLFRMKADAAKADVFFLMSGMWRTSTERFFQWIGGFRPSELLNVVMPYVEPLTDQQLLEVRNLQQSSQQAEEALSQGLDKLQQGLVESIAIQIKVVESVNHGAPMASAMENLQALESFVNQADHLRQQTLQQMSKILTTRQAARGLLALGEYFHRLRALSSLWAARPREHT

SEQ ID NO: 817 - DNA, 2161 bp, Arabidopsis thaliana
  G553 DNA sequence used for BLAST
tcaagtgtgttctcgtggacgagctgcccagagagaactaagagcacgcagcctgtggaagtattctcctagagcgagcaaccctcgagcagcctgtcttgtcgtcaatatcttactcatttgctgcagggtctgttgtctcagatgatccgcctgttccaatattgtcagagattttgtttgtgaaatccatgctcacaaagtttctaatcaaaaatgaaaataaactttggattcatggagactgcaaaagcacaaagcaaatacacttagcgttacctggttcacaaaactctccaatgcttgaagattctccatggctgaagccattggagccccgtgattcacagactcaacaacttttatctgaattgctatgctttcgaccaaaccctgctgaagtttatctaagccttgagagagagcctcctctgcttgctgagacgactgttgcaggttacgcacctccaacagttgctgatcggttaagggctcaacgtatggcatcacaacctagacaacaaaaaaggttgagcattttttctcaagagtagaaagagaaacgtgtaaaagtaaaaaagaagtttacatttaaaagctcggatgggcggaaacctccaatccattggaagaagcgttcagttgaagttcgccacattcccgacatcaagaagaacacatcagcctttgcagcatcagctttcatgcggaagagatttgcgtagtggttcaagcaactatctaccaacattttgagctcaatgtcacctatatgagcttggagcgctgttcgaatctcactaactctcctgttttgctcttctagccagtgtgtgtattccatctcaaatgcagcaatacctgaaaatggttattattgggaaaattacttctttatctactgaggattaagagataaagcaatgctaacatatgcttatttagtgatataaacaccaacctgagttcatattcccagctggtcctagataactagtatctgaagaattgcgtacgcataatccctaatacaaaccagaagaatcactgagtcagaatgaatcagataaagtttgatgaacacacaacaaataaacaagcttgagctaacctgctgcctagctcttacaagttcctgctcgagctgtgacaacttcaaccggctttcttctaactgttgaacatgggcctacaagcacagacacaactttgcataagctttcctttttatcattaacacaagaaaaaatcccaccaaggttaccttctttctcaaacgacttttgcgagcagcttctcggttctgagccaaacgccgtttcatctgttcatagagaaggaacaacaattcatgtcatcacgccgtgtctcttcctctaaagattaaaatggagaaggaggagtttatgaagtcttcgaagcaaaaggtataagtagccttaaaatgctaaagccttaccttatcattgatccggtcttcgtcctgatcattattactcgacggttctgcttcaagagagttattatacacagaagtataattcacctgcaacataattaaccatcaatcaccaaacaaacaacacttataaatcattctaaagcatgatccaggaataaacaataactcactctattgttatcatctgcttctggtctagcatcaacctcaagtgttgttgaagaactctgattgttattctgattactagtaatattgttgatatctgatttgaaaggactctcccaaccagataactgttgaaatggttcatacatccccatgtctctgaatgatacaacttgagtagtagaagaagaagagctcatcatctgtaaatcaacaatttacagactcaagcttattgaattcaagaaacagattctctagctcagctttcaatagatatatagatccagtccatatctctaaaattgcattgcttactaacacacacaataaacaagtagttatagtttcagttttagcaataaaggttgaaactttagaaaacccagctctccaaaacagagccttttgaagaaacatagccaaatagagtaatacccatgaaactagaaagttgcaacaactaaaaaccaaaattggaaaatttaaggacttcacaaagcaagaaaagataacatgagaaacaaaaac

SEQ ID NO: 818 - DNA, 1832 bp, Arabidopsis thaliana
  G554 cDNA Sequence
ccttccaaacactattggggaaatggcttcttctcttttttccggtgtaggtttaaggttttagatttgaaggcggatggtgaggagtttgtgttgatgaaatgggtgatttgaagttaaatacctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtgtcagaggatacttcccatggaacagcaggaactcctcacatgttcgatcaagaagcttcaacgtctagacatcccgataagatacaaagacggcttgctcaaaaccgcgaggctgctaggaaaagtcgcttgcgcaagaaggcttatgttcagcaactggaaacaagcaggttgaagctaattcaattagagcaagaactcgatcgtgctagacaacagggattctatgtaggaaacggaatagatactaattctctcggtttttcggaaaccatgaatccagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggttcttttgccacattttgatgtcttgacggatcaacaacttctagatgtatgcaatctaaaacaatcgtgtcagcaagcagaagacgcgttgactcaaggtatggagaagctgcaacacaccttgcggaccgttgcagcgggacaactcggtgaaggaagttacattcctcaggtgaattctgctatggatagattagaagctttggtcagtttcgtaaatcaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagttt

SEQ ID NO: 819 - protein, 367 aa, Arabidopsis thaliana
  G554 Amino Acid Sequence
MNSTSTHFVPPRRVGIYEPVHQFGMWGESFKSNISNGTMNTPNHIIIPNNQKLDNNVSEDTSHGTAGTPHMFDQEASTSRHPDKIQRRLAQNREAARKSRLRKKAYVQQLETSRLKLIQLEQELDRARQQGFYVGNGIDTNSLGFSETMNPGIAAFEMEYGHWVEEQNRQICELRTVLHGHINDIELRSLVENAMKHYFELFRMKSSAAKADVFFVMSGMWRTSAERFFLWIGGFRPSDLLKVLLPHFDVLTDQQLLDVCNLKQSCQQAEDALTQGMEKLQHTLRTVAAGQLGEGSYIPQVNSAMDRLEALVSFVNQADHLRHETLQQMYRILTTRQAARGLLALGEYFQRLRALSSSWATRHREPT

SEQ ID NO: 820 - DNA, 1709 bp, Arabidopsis thaliana
  G554 Genomic Sequence
atgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtggtacttttttacttcattgctcttcaacctcctgatgataaatttgtttggtctgttttcagaaatttaaactagctttcatttcttgacaatcttttttttttttttatagtcagaggatacttcccatggaacagcaggaactcctcacatgttcgatcaagaagcttcaacgtctagacatcccgataaggttagctattcaaatacttctctatcagtttcttaatcataaatttctacgcatcatatagactaaatcgttatatcgttacagatacaaagacggcttgctcaaaaccgcgaggctgctaggaaaagtcgcttgcgcaagaaggtatgacttcattttcttccccttggtaaactgtttctgtttgcctaatgagttgagagatttgattgttttttttttttgcaggcttatgttcagcaactggaaacaagcaggttgaagctaattcaattagagcaagaactcgatcgtgctagacaacaggttaatgaaatgaaatctaaatatatattcgctttctttcgagttccaaaatataatgcaatttctgattgaatatgaatgttttcagggattctatgtaggaaacggaatagatactaattctctcggtttttcggaaaccatgaatccaggttttgaatcaagaacaatgagtcttttggaaaaaatatagaattcaagattttgattggtggaagcttatttgatttgcagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggtataaaacaaataacaatctagcgtaatgtttaatgaatagaaggaaacaagcaagattacaatgtttcaaatgtttttttttgtaggttcttttgccacattttgatgtcttgacggatcaacaacttctagatgtatgcaatctaaaacaatcgtgtcagcaagcagaagacgcgttgactcaaggtatggagaagctgcaacacacccttgcggactgcgttgcagcgggacaactcggtgaaggaagttacattcctcaggtgaattctgctatggatagattagaagctttggtcagtttcgtaaatcaggtaaaatatatatattcaaactcatttgaaaatactatagtatcagtttcttgattttgtttgttcattcttaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtga

SEQ ID NO: 821 - DNA, 1709 bp, Arabidopsis thaliana; identical to SEQ ID NO: 820
  G554 DNA sequence used for BLAST

SEQ ID NO: 822 - DNA, 1360 bp, Arabidopsis thaliana
  G555 cDNA Sequence
caaaagtagtaacctttgttggtgattgatactatatctgttgtgggttttagacaaagaccacgtctttgcagttgtagattggaattttccggatctttctctaaatcgctttttctccgagcaacttttgtttggggttaagctcaaagaatccgttcttttcagtctttactccatctagggtaccacgattggatcggtttttatctgatgatttagtaacagagattttgaagaaaaagaaaaatgggagatactagtccaagaacatcagtctcaacagatggagacactgatcataataacctaatgttcgatgaagggcatttgggtatcggtgcttctgattctagtgaccgttcaaagagtaaaatggatcaaaagacgcttcgtaggctcgctcaaaaccgtgaggctgcaaggaaaagcagattgaggaagaaagcatatgttcagcagctagagaacagtcgattgaagctaacacaacttgagcaggagctacaaagagcacggcaacagggtgtctttatctcaagctctggagaccaagcccattctaccgctggagatggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaagcttatagcgtgtcagttggagcccttgacagaacaacaatcgctagacataaataacttgcaacagtcaactcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggctgataacttaaggctacaaacatatcaacagatggtgagactattaacaacccgacaatcggctcgtgctctccttgcagtacacaattatacattgcggttacgtgctcttagctctctatggcttgccagaccaagagagtgaaccatgactctattatacttcaacgaaggtccagaaaatttgagattcttagcataagatttgacgactttagacacgtagctcgtatacaagattatgattatactgttttgtgttg

SEQ ID NO: 823 - protein, 330 aa, Arabidopsis thaliana
  G555 Amino Acid Sequence
MGDTSPRTSVSTDGDTDHNNLMFDEGHLGIGASDSSDRSKSKMDQKTLRRLAQNREAARKSRLRKKAYVQQLENSRLKLTQLEQELQRARQQGVFISSSGDQAHSTAGDGAMAFDVEYRRWQEDKNRQMKELSSAIDSHATDSELRIIVDGVIAHYEELYRIKGNAAKSDVFHLLSGMWKTPAERCFLWLGGFRSSELLKLIACQLEPLTEQQSLDINNLQQSTQQAEDALSQGMDNLQQSLADTLSSGTLGSSSSGNVASYMGQMAMAMGKLGTLEGFIRQADNLRLQTYQQMVRLLTTRQSARALLAVHNYTLRLRALSSLWLARPRE

SEQ ID NO: 824 - DNA, 1659 bp, Arabidopsis thaliana
  G555 Genomic Sequence
atgggagatactagtccaagaacatcagtctcaacagatggagacactgatcataataacctaatggttagcttgtaaaatttctaggtcttgcttctttatgttcattaaatggccaaagttttgaaataaaacagtatttatgcagttcgatgaagggcatttgggtatcggtgcttctgattctagtgaccgttcaaagagtaaaatggatcaaaaggtgaatataaacatctctattttgcaagagtttggtttttgtcattgagcctttcagttatgtttttcttgtttgttgttgtaatcaacagacgcttcgtaggctcgctcaaaaccgtgaggctgcaaggaaaagcagattgaggaagaaagtatgcttagatttatgttcatagtttcaattcttttatgttttttacaagcatagctatttgcaaactctaagatgtttgttggttactgcacttttaggcatatgttcagcagctagagaacagtcgattgaagctaacacaacttgagcaggagctacaaagagcacggcaacaggttttaactttgttcagctatatttgtgtagatatttgctctgttgcatacataacatttttctcttaatcttagggtgtctttatctcaagctctggagaccaagcccattctaccgctggagatggtgagttagctgaatcataattcataaccatttattgatgatgtggttgaaaattttagttttgttggttataaagtagagcaagcactagtttggttgatggtgttgatcactttcttgtgagataattttttatgaatgcttctcttttacaggggcaatggcatttgatgtagaatacagacgatggcaggaagataaaaacagacagatgaaggagctgagttctgctatagattctcacgcgactgattctgagcttcggataattgtagatggagtaatagctcactatgaggagctttacaggataaaaggcaacgcagctaagagtgatgtcttccatttattatcagggatgtggaaaaccccagctgagagatgtttcttgtggctcggcggtttccgttcatcagaacttctcaaggtaaaaaacacacgaccaggttcggtttatttggtctcttcactagcaagtttccaaactttttacttctctactacagcttatagcgagtcagttggagcccttgacagaacaacaatcgctagacataaataacttgcaacagtcttctcagcaagcagaagatgctttgtctcaagggatggacaacttacagcaatcactcgctgatactttatcgagtgggactctcggttcaagttcatcagggaatgtagctagctacatgggtcagatggccatggcgatggggaagttaggtacccttgaaggatttatccgccaggtacgttacaattttgttgtttaacatcaaatgaaaaaagtattttgcagtcagttgatagaaccatcttattgtttgtggcaggctgataacttaaggctacaaacatatcaacagatggtgagactattaacaacccgacaatcggctcgtgctctccttgcagtacacaattatacattgcggttacgtgctcttagctctctatggcttgccagaccaagagagtga

SEQ ID NO: 825 - DNA, 1659 bp, Arabidopsis thaliana; identical to SEQ ID NO: 824
  G555 DNA sequence used for BLAST

SEQ ID NO: 826 - DNA, 842 bp, Arabidopsis thaliana
  G557 cDNA Sequence
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 827 - protein, 168 aa, Arabidopsis thaliana
  G557 Amino Acid Sequence
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 828 - DNA, 1218 bp, Arabidopsis thaliana
  G557 Genomic Sequence
atgcaggaacaagcgactagctctttagctgcaagctctttaccatcaagcagcgagaggtcatcaagctctgctccacatttggagatcaaagaaggtaaacaaaaattgtcgattgttttattttcatatcttctcccaacgagtgatctcattgattttcattctcatgcattggatatctagtaaattcacatctagattttgtatcaccattgattcacatctagattcacaacttttagtctcccccagaagatctgcaattttttattgtatttaaaaagtttgaaacttttcgtctaaagtctcttttatgttttaaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggtgtctttttctctattcattgaatttacatttttaccctttatatggaaggtgattatgttaaataacggttgcgtgatggggttgtttggtaattttgtggtgaaaaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatgtacgttttgtcgatcttactgttgacttaacctgcaacgtcaatgcttttgccatttgttttttgatatatcacagtactggtttatcacatttacgagtctaggattgaccaataattagtttagttagttaaaaggatctaagaagctaacttaagctttagattaattctcagaaggcatgtaggttcttgaaatggtcattcactcgcatattctctcaaaaggcatgtaaattcttcaatggttcttgaaatgctcactcattttgttctatatgaatggagaagatgagattgcaaagttggatctctatgtgtgtgtgtggtaataaagtcttttgagttgttatgttttttatgtggtgtagattctgaagaacacaacaggaaacaagagaggaggtggtggtggttctaatgctgatgcaagcctttga

SEQ ID NO: 829 - DNA, 1218 bp, Arabidopsis thaliana
  G557 DNA sequence used for BLAST
tcaaaggcttgcatcagcattagaaccaccaccacctcctctcttgtttcctgttgtgttcttcagaatctacaccacataaaaaacataacaactcaaaagactttattaccacacacacacatagagatccaactttgcaatctcatcttctccattcatatagaacaaaatgagtgagcatttcaagaaccattgaagaatttacatgccttttgagagaatatgcgagtgaatgaccatttcaagaacctacatgccttctgagaattaatctaaagcttaagttagcttcttagatccttttaactaactaaactaattattggtcaatcctagactcgtaaatgtgataaaccagtactgtgatatatcaaaaaacaaatggcaaaagcattgacgttgcaggttaagtcaacagtaagatcgacaaaacgtacatgtctaagcatctggttctcgttctgaagagtagagagtcgctcttcaagttcagagtttttgttctccaagtctttcactctgttttccaactcgctcaagtaagcctttttcctctctcttgcttgctgagctgaaactctgttcctcaacaaccttttcaccacaaaattaccaaacaaccccatcacgcaaccgttatttaacataatcaccttccatataaagggtaaaaatgtaaattcaatgaatagagaaaaagacacctcttcagccgcttgttctctttctccgccggtgtcctccctcgcttcctttgactttctccgacagtcgcctgtgtccgctcctgaccggtcgccgatccagattctctaccggaagtttcttttccgacagcttctcctccaaactccggcactcgccgtatctcctcatcgctttcaattcctttaaaacataaaagagactttagacgaaaagtttcaaactttttaaatacaataaaaaattgcagatcttctgggggagactaaaagttgtgaatctagatgtgaatcaatggtgatacaaaatctagatgtgaatttactagatatccaatgcatgagaatgaaaatcaatgagatcactcgttgggagaagatatgaaaataaaacaatcgacaatttttgtttaccttctttgatctccaaatgtggagcagagcttgatgacctctcgctgcttgatggtaaagagcttgcagctaaagagctagtcgcttgttcctgcat

SEQ ID NO: 830 - DNA, 1638 bp, Arabidopsis thaliana; identical to SEQ ID NO: 18
  G558 cDNA Sequence

SEQ ID NO: 831 - protein, 330 aa, Arabidopsis thaliana
  G558 Amino Acid Sequence
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 832 - DNA, 1852 bp, Arabidopsis thaliana
  G558 Genomic Sequence
atggctgataccagtccgagaactgatgtctcaacagatgacgacacagatcatcctgatcttggggttagctcataatctggctagattttatcacttatattcttcaaaatagtgtgattttttatggaccaaacaaaaattctggtgttaattttaatgcagtcggagggagcactagtgaatactgctgcttctgattcgagtgaccgatcgaagggaaagatggatcaaaaggtgacatgtccatctctgtagataagatcactgtttttattcagccaatttataatctctttttgtttccttatattttgatccatagactcttcgtaggcttgctcaaaaccgtgaggcagcaaggaaaagcagattgaggaagaaggtatattaccttccattggttttatctttttttactttttcttttctttttaaattggtgcatcgctagaagcatagctatttggtactacgttaattccttttaattgctccctccataggcttatgttcagcagctagagaacagccgcttgaaactaacccagcttgagcaggagctgcaaagagcaagacagcaggttcaaatttgtttcttatttctattgatttttattttgttattctgtatacctaacggtaaatttcttgtttctagggcgtcttcatttcaggcacaggagaccaggcccattctactggtggaaatggttggttgcttattctccattagttttaattatgtttattttttggcttctaatttgtgtataagttaagttcatatatcaacttcctgttgacttggtgtagactgatcaattagtacatcatatctcatcccattacaatacactgggttatcagagtcagtggcagactgacatggttctgatagcaaaaactgttattctaattagcactggtgtagatttagatttacaagatgacgaatctcatgggtttgttttgatcatgtataaattttttaattcaggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaaggtgaggtcaaatttcactttgtcttcaccgattgcatctgtttctacatagaacataaaaagaatggtcatagggaaaaatgtgttgaaacagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggtacaacacttgtgatgttttgagatgatatcttagttaagagtatatatatatatcaataggttaataatcgtctcttggttggtggtggcaggctgataatttgagactacaaacattgcaacagatgataagagtattaacaacgagacagtcagcacgtgctctacttgcaatacacgattacttctcacggctacgagctctaagctccttatggcttgctcgacccagagagtga

SEQ ID NO: 833 - DNA, 1852 bp, Arabidopsis thaliana; identical to SEQ ID NO: 832
  G558 DNA sequence used for BLAST

SEQ ID NO: 834 - DNA, 1407 bp, Arabidopsis thaliana; identical to SEQ ID NO: 107
  G559 cDNA Sequence

SEQ ID NO: 835 - protein, 398 aa, Arabidopsis thaliana
  G559 Amino Acid Sequence
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 836 - DNA, 1625 bp, Arabidopsis thaliana
  G559 Genomic Sequence
atggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactga

SEQ ID NO: 837 - DNA, 1625 bp, Arabidopsis thaliana; identical to SEQ ID NO: 836
  G559 DNA sequence used for BLAST

SEQ ID NO: 838 - DNA, 1389 bp, Arabidopsis thaliana
  G560 cDNA Sequence
tgccgcctctccgacagattcaatgaagcagcaaaagagataaaaccctaacaaaagtaaacaatcggagttttaatcttcttcttcttcggagccggagttttgtctgatctgtcggagaggacgtgtcggcatctattaaaatcctagctggacttccacatcactttactcaattagaagctgttttgagtaacacaagtaagtagtaagcttataaaacaatgggaacgagcgaagacaagatgccatttaagactaccaaaccaacatcttcggctcaggaagttcctcccacaccgtatccagattggcaaaattcaatgcaggcttattatggcggaggaggatctccaaatccttttttcccatccccagttggatctcctagtcctcacccctatatgtggggtgctcaacaccatatgatgccgccttatggcaccccagttccgtacccagcaatgtatcccccgggggcagtctatgctcatcctagcatgcccatgcctcctaattctggtcctaccaacaaggagcctgcgaaggaccaagcttctggcaagaagtcaaaggggaactcgaaaaaaaaggctgaaggaggtgataaagcgctctctggttcagggaacgatggtgcctctcatagtgatgaaagtgtcacagcgggttcatctgatgaaaatgatgagaatgccaatcaacaggaacagggttcaattcgaaagccaagctttggacagatgcttgctgacgcaagttctcaaagtacgactggtgaaatccaaggttcggtgcccatgaagccggtagccccggggactaatctgaatatcgggatggacttatggtcttcccaagctggtgtaccagtgaaggatgaacgagagctcaagcggcagaagaggaaacaatctaaccgtgaatccgctaggcggtctagattgcggaagcaggccgaatgcgaacaacttcaacaaagagtagagagtttgtcgaacgagaatcaaagcctgagagatgagctacagagactctcaagcgaatgtgataagctcaagtctgagaacaactcaatccaggatgagttgcagagagtacttggagcagaggctgtagctaatctagaacagaatgctgctgggtcgaaagatggtgaaggaacaaattaacacttaggaaaattggaactttacaacggattattgggatttttcaacaccggataaaaaaaactgagtccaaagtcatttgagattacgtaactatacaatcgtttgacatttttgtgtaatagagatttgacctacaagactgtagaagctgcaaaagctacgattacactttgttttattagtcttcgtgattggaatcggattctgaatccga

SEQ ID NO: 839 - protein, 315 aa, Arabidopsis thaliana
  G560 Amino Acid Sequence
MGTSEDKMPFKTTKPTSSAQEVPPTPYPDWQNSMQAYYGGGGSPNPFFPSPVGSPSPHPYMWGAQHHMMPPYGTPVPYPAMYPPGAVYAHPSMPMPPNSGPTNKEPAKDQASGKKSKGNSKKKAEGGDKALSGSGNDGASHSDESVTAGSSDENDENANQQEQGSIRKPSFGQMLADASSQSTTGEIQGSVPMKPVAPGTNLNIGMDLWSSQAGVPVKDERELKRQKRKQSNRESARRSRLRKQAECEQLQQRVESLSNENQSLRDELQRLSSECDKLKSENNSIQDELQRVLGAEAVANLEQNAAGSKDGEGTN

SEQ ID NO: 840 - DNA, 1903 bp, Arabidopsis thaliana
  G560 Genomic Sequence
atgggaacgagcgaagacaagatgccatttaagactaccaaaccaacatcttcggctcaggttaatccttctcttctcctttcttttcaacatctttgttctgttttatattttaaggtgtttgatgtatctacctctctctttttcaggaagttcctcccacaccgtatccagattggcaaaattcaatgcaggttcgtgttacatgtacaactttggtcactattagtttttatagtgtaagtgaatactttctcgaaaacaccgggactgctgaacataatagtatatgcttatttctttaggcttattatggcggaggaggtactccaaatccttttttcccatccccagttggatctcctagtcctcacccctatatgtggggtgctcaagtaagttttgtatcgtatagttgttgatatgattctatgaaaaagaagtttgcatcttattctttggataacactaaatgagtttctctgttttgcattactttcagcaccatatgatgccgccttatggcaccccagttccgtacccagcaatgtatcccccgggggcagtctatgctcatcctagcatgcccatggtaatctccataccattaatacaacattagctatcgttgaaagctttttgctctgttacatggcaatgcatagataaatgagaaagtaaaaaacttgctcgacatttcttttgttgtagcctcctaattctggtcctaccaacaaggagcctgcgaaggaccaagcttctggcaagaagtcaaaggggaactcgaaaaaaaaggctgaaggaggtgataaagcgctctctggttcagggaacgatggtgcctctcataggtgatttttataacactctactcaacgtggtgcttgttcagtttgattgcagtgtcatatgtaattatgatttttccgttgtgcagtgatgaaagtgtcacagcgggttcatctgatgaaaatgatgagaatgccaatcaacaggtactgttatgtgtttgaagtgttctctgttgctacaatactttgtgatgtgcttcattgagattcatgttaatgtaggaacagggttcaattcgaaagccaagctttggacagatgcttgctgacggtatgcttttgaccgctgcagttttcatggtttttctttgcatgtattttccatgtttcttgacttggtaaagtttccttgaacagcaagttctcaaagtacgactggtgaaatccaaggttcggtgcccatgaagccggtagccccggggactaatctgaatatcgggatggacttatggtcttcccaagctggtgtaccagtgaaggtgtgaccaactcctcatttcaccctgcaaggttgcttttccgaattcgttacattcttccttacaaaatcctctgattactcaacaggatgaacgagagctcaagcggcagaagaggaaacaatctaaccgtgaatccgctaggcggtctagattgcggaagcaggtaatatgcatttgtgtgttagtatcattttactctgtctgcttcttgtaatttactcattccataataaaccatttcgaataggccgaatgcgaacaacttcaacaaagagtagagagtttgtcgaacgagaatcaaagcctgagagatgagctacagagactctcaagcgaatgtgataagctcaagtctgagaacaactcaatccaggtgacaaactctttatccggaaaaatttctgcgaaaatcatactctttccaacttttatcttatttctatcggcttgcatttacactagagtcatggaataatgcaggatgagttgcagagagtacttggagcagaggctgtagctaatctagaacagaatgctgctgggtcgaaagatggtgaaggaacaaattaa

SEQ ID NO: 841 - DNA, 1903 bp, Arabidopsis thaliana
  G560 DNA sequence used for BLAST
ttaatttgttccttcaccatctttcgacccagcagcattctgttctagattagctacagcctctgctccaagtactctctgcaactcatcctgcattattccatgactctagtgtaaatgcaagccgatagaaataagataaaagttggaaagagtatgattttcgcagaaatttttccggataaagagtttgtcacctggattgagttgttctcagacttgagcttatcacattcgcttgagagtctctgtagctcatctctcaggctttgattctcgttcgacaaactctctactctttgttgaagttgttcgcattcggcctattcgaaatggtttattatggaatgagtaaattacaagaagcagacagagtaaaatgatactaacacacaaatgcatattacctgcttccgcaatctagaccgcctagcggattcacggttagattgtttcctcttctgccgcttgagctctcgttcatcctgttgagtaatcagaggattttgtaaggaagaatgtaacgaattcggaaaagcaaccttgcagggtgaaatgaggagttggtcacaccttcactggtacaccagcttgggaagaccataagtccatcccgatattcagattagtccccggggctaccggcttcatgggcaccgaaccttggatttcaccagtcgtactttgagaacttgctgttcaaggaaactttaccaagtcaagaaacatggaaaatacatgcaaagaaaaaccatgaaaactgcagcggtcaaaagcataccgtcagcaagcatctgtccaaagcttggctttcgaattgaaccctgttcctacattaacatgaatctcaatgaagcacatcacaaagtattgtagcaacagagaacacttcaaacacataacagtacctgttgattggcattctcatcattttcatcagatgaacccgctgtgacactttcatcactgcacaacggaaaaatcataattacatatgacactgcaatcaaactgaacaagcaccacgttgagtagagtgttataaaaatcacctatgagaggcaccatcgttccctgaaccagagagcgctttatcacctccttcagccttttttttcgagttcccctttgacttcttgccagaagcttggtccttcgcaggctccttgttggtaggaccagaattaggaggctacaacaaaagaaatgtcgagcaagttttttactttctcatttatctatgcattgccatgtaacagagcaaaaagctttcaacgatagctaatgttgtattaatggtatggagattaccatgggcatgctaggatgagcatagactgcccccgggggatacattgctgggtacggaactggggtgccataaggcggcatcatatggtgctgaaagtaatgcaaaacagagaaactcatttagtgttatccaaagaataagatgcaaacttctttttcatagaatcatatcaacaactatacgatacaaaacttacttgagcaccccacatataggggtgaggactaggagatccaactggggatgggaaaaaaggatttggagtacctcctccgccataataagcctaaagaaataagcatatactattatgttcagcagtcccggtgttttcgagaaagtattcacttacactataaaaactaatagtgaccaaagttgtacatgtaacacgaacctgcattgaattttgccaatctggatacggtgtgggaggaacttcctgaaaaagagagaggtagatacatcaaacaccttaaaatataaaacagaacaaagatgttgaaaagaaaggagaagagaaggattaacctgagccgaagatgttggtttggtagtcttaaatggcatcttgtcttcgctcgttcccat

SEQ ID NO: 842 - DNA, 1413 bp, Arabidopsis thaliana; identical to SEQ ID NO: 28
  G561 cDNA Sequence

SEQ ID NO: 843 - protein, 360 aa, Arabidopsis thaliana
  G561 Amino Acid Sequence
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 844 - DNA, 2042 bp, Arabidopsis thaliana
  G561 Genomic Sequence
atgggtagcaacgaagaaggaaaccccactaacaactctgataagccatcgcaagctgctgctcctgtaagtaatggaatcaatggaaactgattggtttagtaacagatttgtgtttagtcaaagtttgattgttgttgttgttttactttgtatatatacaggagcagagtaatgttcatgtgtatcatcatgactgggctgctatgcaggtgatttttctttgaccttgttttgtttctgctgtgtgaattgtgttttattagcctgagtgattttagcttgtttctcatgatatttgtaggcatattatgggcctagagttggtatacctcaatattacaactcaaatttggcgcctggtcatgctccaccgccttatatgtgggcgtctccatcggtacttatattaaacttgttgaatgtatatctgttactttggattgagtttgatctttttttgttgttgtagccaatgatggctccttatggagcaccatatccaccattttgccctcctggtggagtttatgctcatcctggtgttcaaatggtaatcctcccttccttttagtggttactttatatcaacaaatagttgaaaagaccagatttactgatttgtgttttcctactttactttaccagggctcacaaccacaaggtcctgtttctcaatcagcatctggagtaagtcaattgtcttgtgatgtttctgtgtgaaatgtgcagtatgatggatattggatatgaatgtatgagaatgtttgcaggttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagaggtttgtcaaactagcctcaactctttcttattcaatagatacttagatatatagaatctaacgtggttttgatatcaactagctccgagaatgatggctctagcaatggtagtgatggtaatacaactggggtatggactcgtcctctctgctctgaactaggtttagatttatcttttgcgatctttattcatattcttctttttttattaccacagggagaacaatctaggaggaaaagaaggcaacaaagatcaccaagcactggtatttcttcctgaaaaataacacaacgcaaataattttatgcttttaatgtttacaactatttaaagctaatggcttttgtacttggtaggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatgggtatagtattcttgtgccactctcgttgacttcatttattcgtgacatccccttttgtttgtttattggtgttagtgtgtgtttatctgcagaatgaaaaagaggttaaacgagagaagagaaaacagtcaaaccgagaatctgctaggaggtcaagactgaggaagcaggtgattgctactaaacattttgtaactaaagactaatgatgagagctgatagattttcatatttacttaatggattgtttgttgttcacataggctgaaacagaacaactatctgtcaaagttgacgcattagtagctgagaacatgtctctgaggtctaaactaggccagctaaacaatgagtctgagaaactacggctggagaacgaagctatattggtaacaatctactcgcattttgaacagtaatcataactctattgatcataataacgctagttattcctctgcaggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctga

SEQ ID NO: 845 - DNA, 2042 bp, Arabidopsis thaliana
  G561 DNA sequence used for BLAST
tcagctagccgcgacaggatcggttatcggacttgcatttaacagttgatgctgcacagttttgctacctgatacagagttgttcttatcaactcgagagatcaggttctctgttttccctgttgcttgcgctttcagttgatcctgcagaggaataactagcgttattatgatcaatagacttatgattactgttcaaaatgcgagtagattgttaccaatatagcttcgttctccagccgtagtttctcagactcattgtttagctggcctagtttagacctcagagacatgttctcagctactaatgcgtcaactttgacagatagttgttctgtttcagcctatgtgaacaacaaacaatccattaagtaaatatgaaaatctatcagctctcatcattagtctttagttacaaaatgtttagtagcaatcacctgcttcctcagtcttgacctcctagcagattctcggtttgactgttttctcttctctcgtttaacctctttttcattctgcagataaacacacactaacaccaataaacaaacaaaaggggatgtcacgaataaatgaagtcaacgagagtggcacaagaatactatacccatggctgtggcacaccgttcatgccagcagagttttggaaactcattgctgtgggcataacaggagtccccatagtcacatcgggtttctcattttcacctctaagaggcagactgttttgagatgagggtctttcacctaccaagtacaaaagccattagctttaaatagttgtaaacattaaaagcatacaattatttgcgttgtgttatttttcaggaagaaataccagtgcttggtgatctttgttgccttcttttcctcctagattgttctccctgtggtaataaaaaaagaagaatatgaataaagatcgcaaaagataaatctaaacctagttcagagcagagaggacgagtccataccccagttgtattaccatcactaccattgctagagccatcattctcggagctagttgatatcaaaaccacgttagattctatatatctaagtatctattgaataagaaagagttgaggctagtttgacaaacctctgagaactcctatgttcactgctgctatgttcagcactcccaactttgttattgcttattgacattgcaagtccatcgaactctttcagctttttcatgaacccatgatctgagtttccagctgaattagctggtgcatcaatggtcaaaggggttgtaacctgcaaacattctcatacattcatatccaatatccatcatactgcacatttcacacagaaacatcacaagacaattgacttactccagatgctgattgagaaacaggaccttgtggttgtgagccctggtaaagtaaagtaggaaaacacaaatcagtaaatctggtcttttcaactatttgttgatataaagtaaccactaaaaggaagggaggattaccatttgaacaccaggatgagcataaactccaccaggagggcaaaatggtggatatggtgctccataaggagccatcattggctacaacaacaaagaaagatcaaactcaatccaaagtaacagatatacattcaacaagtttaatataagtaccgatggagacgcccacatataaggcggtggagcatgaccaggcgccaaatttgagttgtaatattgaggtataccaactctaggcccataatatgcctacaaatatcatgagaaacaagctaaaatcactcaggctaataaaacacaattcacacagcagaaacaaaacaaggtcaaagaaaaatcacctgcatagcagcccagtcatgatgatacacatgaacattactctgctcctgtatatatacaaagtaaaacaacaacaacaatcaaactttgactaaacacaaatctgttactaaaccaatcagtttccattgattccattacttacaggagcagcagcttgcgatggcttatcagagttgttagtggggtttccttcttcgttgctacccat

SEQ ID NO: 846 - DNA, 1554 bp, Arabidopsis thaliana; identical to SEQ ID NO: 97
  G562 cDNA Sequence

SEQ ID NO: 847 - protein, 382 aa, Arabidopsis thaliana
  G562 Amino Acid Sequence
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 848 - DNA, 2043 bp, Arabidopsis thaliana
  G562 Genomic Sequence
tcagcctgcagctactgctttagctcgaggcttcgtatcgagcagttgatgcaatttgcttgtagagttagaatcattgtctccttggttcttgttcttatctccagctcctgagttcttaactctagacaacatatttgcggggactctcttttcgggttccgagcatttcagtttgtcctgcaacccaaaaagaaccggccatgttcaagaaaatgacacgccttcataaagataatttgttggttaatgatagcttacttaccaacaaggttgcatttgctcctcttagtttatcagatttctcattaagttggtttagttcagatcttaatgccatgttttcggctgtcaaggcttccactttcctagcaagttcttctgtctcggccttcaaaacaaggaaagacagtttgttagtttattaaatgttttggtgagagttacacactaagagaaagaatttctaaagagcttcagtgtattctttcagtaaccaaacctgtttccttaatcttgaccttctagcagattctctattagactgtttccttcgctcccgtttcagttctctctcgttctgaagacaaaatttaatacttggtcagggaaacggatcagattagctcgaaaatccaacaagtggaagttgagaataagtcacagggtacctgaagccaagtttcaggaggaaccatggctaaagattgtgacatgaaggggttggaatttgcacttacaccaggagagagtatagctccagatccttgaatgagttttacgccggtatcaccacttgacggagaaacagaatgaaatgagctagcttgaaccaattgtttcccatctgccaaaaaaaccgaattaaaactcccattatatctaatatttacactgattctaactctttgggacatgaataaggctatataccttttgttggagttccctctcgacttcttttaagtttcggttcatctgcctggaaacatgcaataagtgaggttctagactttagacaatcatatgaaaactaaagatagctgagagtaagagaagagaaacattaccccagttgtattcccatcacttccatcagtagaaccatcagtttctgagctgttccgtgatcgtttatgttcatctgcaccattttcaggattcccatttcctagagacatagcaagcccatcaaactctttcagcttcttcatcaatccattgtctgtgttccctgtagatttagtaggagtgtcgatgctcaaaagcgtccccggctgcgataaagaagaactatccattaaacagcgaacaaaaccatttctcaatctttgatgtatcaaactaggtatacaacttacagttgttaaaggtggatccttttgaccttgaggcagtgatccctgtccacagaaactcaaagccaagtcagataaacgatcacggaggattcaactacgagatgtttgaggaacagaattactatataccatgggaataccgggatgagcgtaaactcctcctccatgaggataaacagcagcatagggtgctccatatggtgacatcatatgctgaaagggatttaagaccaacaaaacaccaatgaaacgtcttcctaatctttaccatattagcacaagatgattcgtgtttgtgtttagtacctgaggattccacatgtaaggaggaggaggatgaccagatgcagccatagctgaattgtaataaggaggcattgctactcttggaccataatatgcctagcagcaacacatcatgaaaatcattattaatcatggtattactagtacataactggagcgtaataaaaaaaagactaacctgcatagctgcccaatcagggtagacatgaacatttgtttgatcctatcaacaagagtcaagtcaacgcataaggaatttaagaaaaactaaattgactttggaattatggtttgaaactgttcaacataccaccgggggtgaagatggtttatctgatttggtaggaggctttggttcctcgctgctatttcccat

SEQ ID NO: 849 - DNA, 2043 bp, Arabidopsis thaliana; identical to SEQ ID NO: 848
  G562 DNA sequence used for BLAST

SEQ ID NO: 850 - DNA, 916 bp, Arabidopsis thaliana
  G563 cDNA Sequence
attgttctttctctttgacaaaacccagatagataaaaattcgttccaattccagtgagctccggaaatggcgtccttcaagttgatgtcttcttccaattccgacttgtctcgccgtaattcttcttctgcttcatcttccccttctataagatcatcgcaccatctccgaccaaatcctcacgccgatcactccagaatcagtttcgcttacggcggaggagtcaacgattacactttcgcgtctgattcaaagcccttcgagatggcgattgatgttgatcggagtatcggagatcggaacagcgttaacaacggaaagagtgttgacgatgtttggaaagagattgtatctggagagcaaaagacgatcatgatgaaggaagaagaaccagaagatataatgacacttgaggatttcttagcgaaagcagaaatggacgagggagcttcagatgaaatcgatgtgaagattccaacggagagactcaacaacgacggtagctatacatttgattttccgatgcagcgacacagttcgttccagatggttgaaggatcaatgggtggaggagtaacgagaggaaagagagggagagtgatgatggaggcaatggataaagctgcagctcagagacagaagaggatgatcaagaaccgtgaatccgctgctaggtctcgagagaggaaacaggcttatcaggttgagttagagactttggctgccaagttagaggaggagaatgagcagcttttgaaggagattgaagagagcactaaagagagatacaagaagctcatggaggttctgattccggtcgatgagaaaccaaggccaccgtcgaggcccttaagcaggagccattccttggaatggtgaagtgtggtaaaaaaaacttttgcggccgcgaattcc

SEQ ID NO: 851 - protein, 270 aa, Arabidopsis thaliana
  G563 Amino Acid Sequence
MASFKLMSSSNSDLSRRNSSSASSSPSIRSSHHLRPNPHADHSRISFAYGGGVNDYTFASDSKPFEMAIDVDRSIGDRNSVNNGKSVDDVWKEIVSGEQKTIMMKEEEPEDIMTLEDFLAKAEMDEGASDEIDVKIPTERLNNDGSYTFDFPMQRHSSFQMVEGSMGGGVTRGKRGRVMMEAMDKAAAQRQKRMIKNRESAARSRERKQAYQVELETLAAKLEEENEQLLKEIEESTKERYKKLMEVLIPVDEKPRPPSRPLSRSHSLEW

SEQ ID NO: 852 - DNA, 823 bp, Arabidopsis thaliana
  G563 Genomic Sequence
atggcgtccttcaagttgatgtcttcttccaattccgacttgtctcgccgtaattcttcttctgcttcatcttccccttctataagatcatcgcaccatctccgaccaaatcctcacgccgatcactccagaatcagtttcgcttacggcggaggagtcaacgattacactttcgcgtctgattcaaagcccttcgagatggcgattgatgttgatcggagtatcggagatcggaacagcgttaacaacggaaagagtgttgacgatgtttggaaagagattgtatctggagagcaaaagacgatcatgatgaaggaagaagaaccagaagatataatgacacttgaggatttcttagcgaaagcagaaatggacgagggagcttcagatgaaatcgatgtgaagattccaacggagagactcaacaacgacggtagctatacatttgattttccgatgcagcgacacagttcgttccagatggttgaaggatcaatgggtggaggagtaacgagaggaaagagagggagagtgatgatggaggcaatggataaagctgcagctcagagacagaagaggatgatcaagaaccgtgaatccgctgctaggtctcgagagaggaaacaggcttatcaggttgagttagagactttggctgccaagttagaggaggagaatgagcagcttttgaaggagattgaagagagcactaaagagagatacaagaagctcatggaggttctgattccggtcgatgagaaaccaaggccaccgtcgaggcccttaagcaggagccattccttggaatggtgaagtgtggtaa

SEQ ID NO: 853 - DNA, 813 bp, Arabidopsis thaliana
  G563 DNA sequence used for BLAST
tcaccattccaaggaatggctcctgcttaagggcctcgacggtggccttggtttctcatcgaccggaatcagaacctccatgagcttcttgtatctctctttagtgctctcttcaatctccttcaaaagctgctcattctcctcctctaacttggcagccaaagtctctaactcaacctgataagcctgtttcctctctcgagacctagcagcggattcacggttcttgatcatcctcttctgtctctgagctgcagctttatccattgcctccatcatcactctccctctctttcctctcgttactcctccacccattgatccttcaaccatctggaacgaactgtgtcgctgcatcggaaaatcaaatgtatagctaccgtcgttgttgagtctctccgttggaatcttcacatcgatttcatctgaagctccctcgtccatttctgctttcgctaagaaatcctcaagtgtcattatatcttctggttcttcttccttcatcatgatcgtcttttgctctccagatacaatctctttccaaacatcgtcaacactctttccgttgttaacgctgttccgatctccgatactccgatcaacatcaatcgccatctcgaagggctttgaatcagacgcgaaagtgtaatcgttgactcctccgccgtaagcgaaactgattctggagtgatcggcgtgaggatttggtcggagatggtgcgatgatcttatagaaggggaagatgaagcagaagaagaattacggcgagacaagtcggaattggaagaagacatcaacttgaaggacgccat

SEQ ID NO: 854 - DNA, 1110 bp, Arabidopsis thaliana
  G564 cDNA Sequence
aatcagcagttcttggtgtttgagacacatgtctccaataatactcagtgagatctttctctctgggtttatgttaaattccacaatcaggcgcaggacccatcttgttcaatctttctctgttgtcttcctttactggctttactatgtctcatgatctctgaacttatctccagttttatatctatacgcataattacaacaaaaccctagtttcttttcaaatttctcttcttcgtttttcgtcatctgggtcctgtcctgttctgttgtgtcttgttctgttctgtttttaattcccctaaaaacccattttaaaatattttatctctcttctcttaaaaaaaactcttccctgtttttgtttgtgtgttactaaatggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtagcaacaacaacaacaacaacaacaacatgggcatgtgttcgaaccctctggttggtttggagtgtgatgatttcttcgtgaatcagatgaacatgtcttatattatgaaccagcctctcatggcgtcttctgatgctttaatgtattaaatgtggacctaaaaaccccctcgaaatcacaaagaaatggggccgtttttatttgtccgatttagagacatgtccaaagagagagatttatatataaaaatgggtctgttgtttgatttgtttccatttcaaatttttgtttgtttgggtccgttttaggcgttaggtatctctaagcatcatcgttatgagtgtgtctgtaataaaggctctgttgccgcatgagtacaaagtgttttcttaatatt

SEQ ID NO: 855 - protein, 160 aa, Arabidopsis thaliana
  G564 Amino Acid Sequence
MESSSSGTTSSTIQTSSGSEESLMEQRKRKRMLSNRESARRSRMKKQKLLDDLTAQVNHLKKENTEIVTSVSITTQHYLTVEAENSVLRAQLDELNHRLQSLNDIIEFLDSSNNNNNNNNMGMCSNPLVGLECDDFFVNQMNMSYIMNQPLMASSDALMY

SEQ ID NO: 856 - DNA, 483 bp, Arabidopsis thaliana
  G564 Genomic Sequence
atggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtagcaacaacaacaacaacaacaacaacatgggcatgtgttcgaaccctctggttggtttggagtgtgatgatttcttcgtgaatcagatgaacatgtcttatattatgaaccagcctctcatggcgtcttctgatgctttaatgtattaa

SEQ ID NO: 857 - DNA, 480 bp, Arabidopsis thaliana
  G564 DNA sequence used for BLAST
atggaatcgtcgtcgtcgggaacaacttcgtcgacgattcaaacgtcgtcaggatcggaggagagtctcatggagcagaggaaacgtaaacggatgctctcaaaccgtgaatctgcaaggagatcaagaatgaagaaacaaaagctcctagacgatctaacggctcaggttaatcatctgaaaaaagagaacacggagatcgtgacaagtgtcagcatcacaacgcaacactacctaaccgttgaagcagagaactctgttctcagagctcagcttgatgaacttaaccacaggctccaatctctcaacgacatcatcgagttcctcgacagtagcaacaacaacaacaacaacaacatgggcatgtgttcgaaccctctggttggtttggagtgtgatgatttcttcgtgaatcagatgaacatgtcttatattatgaaccagcctctcatggcgtcttctgatgctttaatgtattaa

SEQ ID NO: 858 - DNA, 2415 bp, Arabidopsis thaliana
  G566 cDNA Sequence
attcctccataacccctttcttccttttgaatctctccttcttcttcttcatccccaaattcgaaaccctaaccctaaaactcagtttcaaaatggctgaaccaatcaccaaggagcagcctcctccacctgcgccggaccctaattccacctaccctcctccgtccgattttgattccatctcgatccctccgttagatgatcatttctccgatcagactccgattggtgaactaatgtccgatctggggtttcccgatggtgaattcgagctcactttcgacggtatggacgatctttacttccctgctgagaatgagtcgtttctcatccctatcaatacgtccaatcaagaacagtttggtgatttcactccggagtctgaaagttctggaatttccggtgattgtattgttcccaaagatgcagataagactattacaacttccggttgcattaaccgggaatctcctagagattccgatgatcgttgctccggtgctgaccataatttagatctaccgactccattgtcctctcagggttcgggtaattgcggttctgatgtttcggaagctacaaatgaatcgtcgcctaaatcgagaaacgttgcggtcgaccagaaggttaaagtggaagaagctgctacgacgacgacgtctattaccaagaggaagaaagagatcgatgaggatttgactgacgagtctaggaacagtaagtacaggagatcgggagaggattcttacgctagtgctgttaccggtgaagaagatgagaaaaagagagctagactcatgagaaaccgtgaaagtgctcagctttctaggcagaggaagaagcattacgtcgaggagcttgaagaaaaggttaggaatatgcattctacgattacggatttgaacggtaagatatcgtatttcatggctgagaatgctactctaaggcagcaattgggtggcaatggaatgtgcccgccgcatcttccaccacctccgatgggaatgtatccacctatggctccaatgccttatccatggatgccttgtcctccttatatggtgaagcaacaaggatctcaagtgcctttgattcctattcctaggttgaaaccacagaacacccttggaacatccaaggctaagaagtccgagagtaagaagagtgaagctaagaccaagaaggtggctagtattagttttctgggtcttctgttttgtctatttttgtttggtgcattagctccaattgtgaacgttaattatggaggaattagtggtgctttttatgggaactatagatctaattatattactgaccagatttacagtcagcatagggatagagttttggatacatctcgtagtggtgctggtactggggtttctaatagtaatgggatgcatcgtgggagagattctgatcgaggagctaggaaaaatatatctgcaacagagagttctgtcactcctggaaatggtagtgagcctctagttgcatcactctttgttccgaggaatgacaagcttgtgaagatagatgggaatttgattatcaattctatattggcgagtgagaaagccgtggcttcgagaaaggcttctgaatcaaaggagaggaaagctgacttgatgatctctaaagattatacccctgcactgcctctacctgacgtgggaaggacagaggaattggctaagcatctctatagatctaaggctgaaaaacagaaagctctatcctctggctctgctgatactctgaaagaccaagtcaaaacaaaagcagccaacggtgaaatgcagcaatggttccgtgaaggtgttgcaggtcccatgtttagttcagggatgtgcactgaagtgtttcagtttgatgtatcctcaacctctggagccatcattcctgcagctaccaacgtctctgctgaacacggtaagaacaccacagacacacacaagcaacagaacagaagaatccttcgtggtcttcccattccactcccaggatcagattttaacctcacgaaagagcaccaaagaaacagcagtagcaaagaaatcaagcctgcttcatcaatggttgtatctgtgcttgttgatcccagagaaggaggtgatggagatatagatgggatgattgggggaccaaaatcactgtctcgagtttttgtagtcgtgcttctggacagtgcaaagtatgtaacatactcctgtgtcctacctcgatcaggagctcctcatcttgtgaccacttgaagacatatgaggattgaaacatatatcagcaggtcttctctcatataggctttgtatgtaaaagaataaatacctgctctctggtatcccgtaatatccttagctaataccgttgtccggtttttgtttccagatgtagaatccgaatgctgtaact

SEQ ID NO: 859 - protein, 721 aa, Arabidopsis thaliana
  G566 Amino Acid Sequence
MAEPITKEQPPPPAPDPNSTYPPPSDFDSISIPPLDDHFSDQTPIGELMSDLGFPDGEFELTFDGMDDLYFPAENESFLIPINTSNQEQFGDFTPESESSGISGDCIVPKDADKTITTSGCINRESPRDSDDRCSGADHNLDLPTPLSSQGSGNCGSDVSEATNESSPKSRNVAVDQKVKVEEAATTTTSITKRKKEIDEDLTDESRNSKYRRSGEDSYASAVTGEEDEKKRARLMRNRESAQLSRQRKKHYVEELEEKVRNMHSTITDLNGKISYFMAENATLRQQLGGNGMCPPHLPPPPMGMYPPMAPMPYPWMPCPPYMVKQQGSQVPLIPIPRLKPQNTLGTSKAKKSESKKSEAKTKKVASISFLGLLFCLFLFGALAPIVNVNYGGISGAFYGNYRSNYITDQIYSQHRDRVLDTSRSGAGTGVSNSNGMHRGRDSDRGARKNISATESSVTPGNGSEPLVASLFVPRNDKLVKIDGNLIINSILASEKAVASRKASESKERKADLMISKDYTPALPLPDVGRTEELAKHLYRSKAEKQKALSSGSADTLKDQVKTKAANGEMQQWFREGVAGPMFSSGMCTEVFQFDVSSTSGAIIPAATNVSAEHGKNTTDTHKQQNRRILRGLPIPLPGSDFNLTKEHQRNSSSKEIKPASSMVVSVLVDPREGGDGDIDGMIGGPKSLSRVFVVVLLDSAKYVTYSCVLPRSGAPHLVTT

SEQ ID NO: 860 - DNA, 2504 bp, Arabidopsis thaliana
  G566 Genomic Sequence
atggctgaaccaatcaccaaggagcagcctcctccacctgctccggaccctaattccacctaccctcctccgtccgattttgattccatctcgatccctccgttagatgatcatttctccgatcagactccgattggtgaactaatgtccgatctggggtttcccgatggtgaattcgagctcactttcgacggtatggacgatctttacttccctgctgagaatgagtcgtttctcatccctatcaatacgtccaatcaagaacagtttggtgatttcactccggagtctgaaagttctggaatttccggtgattgtattgttcccaaagatgcagataagactattacaacttccggttgcattaaccgggaatctcctagagattccgatgatcgttgctccggtgctgaccataatttagatctaccgactccattgtcctctcagggttcgggtaattgcggttctgatgtttcggaagctacaaatgaatcgtcgcctaaatcgagaaacgttgcggtcgaccagaaggttaaagtggaagaagctgctacgacgacgacgtctattaccaagaggaagaaagagatcgatgaggatttgactgacgagtctaggaacagtaagtacaggagatcgggagaggatgctgacgctagtgctgttaccggtgaagaagatgagaaaaagagagctagactcatgagaaaccgtgaaagtgctcagctttctaggcagaggaagaagcattacgtcgaggagcttgaagaaaaggttaggaatatgcattctacgattacggatttgaacggtaagatatcgtatttcatggctgagaatgctactctaaggcagcaattgggtggcaatggaatgtgcccgccgcatcttccaccacctccgatgggaatgtatccacctatggctccaatgccttatccatggatgccttgtcctccttatatggtgaagcaacaaggatctcaagtgcctttgattcctattcctaggttgaaaccacagaacacccttggaacatccaaggctaagaagtccgagagtaagaagagtgaagctaagaccaagaaggtggctagtattagttttctgggtcttctgttttgtctatttttgtttggtgcattagctccaattgtgaacgttaattatggaggaattagtggtgctttttatgggaactatagatctaattatattactgaccagatttacagtcagcatagggatagagttttggatacatctcgtagtggtgctggtactggggtttctaatagtaatgggatgcatcgtgggagagattctgatcgaggagctaggaaaaatatatctgcaacagagagttctgtcactcctggaaatggtagtgagcctctagttgcatcactctttgttccgaggaatgacaagcttgtgaagatagatgggaatttgattatcaattctatattggcgagtgagaaagccgtggcttcgagaaaggcttctgaatcaaaggagaggaaagctgacttgatgatctctaaagattatacccctgcactgcctctacctgacgtgggaaggacagaggaattggctaagcatctctatagatctaaggctgaaaaacagaaagctctatcctctggctctgctgatactctgaaagaccaagtcaaaacaaaagcagccaacggtgaaatgcagcaatggttccgtgaaggtgttgcaggtaatcatgggtttttgatcttactttctgttcccttgacttggttatgtaggcaggcattgtaggtatactagtccttatcatatcttgatattagacacaagaacattttaatgaggcttaacttaccttcagcaaatctctggtcatgagtagatgtattgtataatctggattagatactaaacactaataaggaacatgtgaaattgttactcatattgtatatttttcttcatctttctcggcagaagctgtaagcgcagtagtagcgtttatatctttcttgttcactaaataataacaccttttttgtttgttaaatgactatattgtaggtcccatgtttagttcagggatgtgcactgaagtgtttcagtttgatgtatcctcaacctctggagccatcattcctgcagctaccaacgtctctgctgaacacggtaagaacaccacagacacacacaagcaacagaacagaagaatccttcgtggtcttcccattccactcccaggatcagattttaacctcacgaaagagcaccaaagaaacagcagtagcaaagaaatcaagcctgcttcatcaatggttgtatctgtgcttgttgatcccagagaaggaggtgatggagatatagatgggatgattgggggaccaaaatcactgtctcgagtttttgtagtcgtgcttctggacagtgcaaagtatgtaacatactcctgtgtcctacctcgatcaggagctcctcatcttgtgaccacttga

SEQ ID NO: 861 - DNA, 2753 bp, Arabidopsis thaliana
  G566 DNA sequence used for BLAST
agttacagcattcggattctacatctggaaacaaaaaccggacaacggtattagctaaggatattacgtgataccagagagcaggtatttattcttttacatacaaagcctatatgagagaagacctgctgatatatgtttcaatcctcatatgtcttcaagtggtcacaagatgaggagctcctgatcgaggtaggacacaggagtatgttacatactttgcactgtccagaagcacgactacaaaaactcgagacagtgattttggtcccccaatcatcccatctatatctccatcacctccttctctgggatcaacaagcacagatacaaccattgatgaagcaggcttgatttctttgctactgctgtttctttggtgctctttcgtgaggttaaaatctgatcctgggagtggaatgggaagaccacgaaggattcttctgttctgttgcttgtgtgtgtctgtggtgttcttaccgtgttcagcagagacgttggtagctgcaggaatgatggctccagaggttgaggatacatcaaactgaaacacttcagtgcacatccctgaactaaacatgggacctacaatatagtcatttaacaaacaaaaaaggtgttattatttagtgaacaagaaagatataaacgctactactgcgcttacagcttctgccgagaaagatgaagaaaaatatacaatatgagtaacaatttcacatgttccttattagtgtttagtatctaatccagattatacaatacatctactcatgaccagagatttgctgaaggtaagttaagcctcattaaaatgttcttgtgtctaatatcaagatatgataaggactagtatacctacaatgcctgcctacataaccaagtcaagggaacagaaagtaagatcaaaaacccatgattacctgcaacaccttcacggaaccattgctgcatttcaccgttggctgcttttgttttgacttggtctttcagagtatcagcagagccagaggatagagctttctgtttttcagccttagatctatagagatgcttagccaattcctctgtccttcccacgtcaggtagaggcagtgcaggggtataatctttagagatcatcaagtcagctttcctctcctttgattcagaagcctttctcgaagccacggctttctcactcgccaatatagaattgataatcaaattcccatctatcttcacaagcttgtcattcctcggaacaaagagtgatgcaactagaggctcactaccatttccaggagtgacagaactctctgttgcagatatatttttcctagctcctcgatcagaatctctcccacgatgcatcccattactattagaaaccccagtaccagcaccactacgagatgtatccaaaactctatccctatgctgactgtaaatctggtcagtaatataattagatctatagttcccataaaaagcaccactaattcctccataattaacgttcacaattggagctaatgcaccaaacaaaaatagacaaaacagaagacccagaaaactaatactagccaccttcttggtcttagcttcactcttcttactctcggacttcttagccttggatgttccaagggtgttctgtggtttcaacctaggaataggaatcaaaggcacttgagatccttgttgcttcaccatataaggaggacaaggcatccatggataaggcattggagccataggtggatacattcccatcggaggtggtggaagatgcggcgggcacattccattgccacccaattgctgccttagagtagcattctcagccatgaaatacgatatcttaccgttcaaatccgtaatcgtagaatgcatattcctaaccttttcttcaagctcctcgacgtaatgcttcttcctctgcctagaaagctgagcactttcacggtttctcatgagtctagctctctttttctcatcttcttcaccggtaacagcactagcgtcagcatcctctcccgatctcctgtacttactgttcctagactcgtcagtcaaatcctcatcgatctctttcttcctcttggtaatagacgtcgtcgtcgtagcagcttcttccactttaaccttctggtcgaccgcaacgtttctcgatttaggcgacgattcatttgtagcttccgaaacatcagaaccgcaattacccgaaccctgagaggacaatggagtcggtagatctaaattatggtcagcaccggagcaacgatcatcggaatctctaggagattcccggttaatgcaaccggaagttgtaatagtcttatctgcatctttgggaacaatacaatcaccggaaattccagaactttcagactccggagtgaaatcaccaaactgttcttgattggacgtattgatagggatgagaaacgactcattctcagcagggaagtaaagatcgtccataccgtcgaaagtgagctcgaattcaccatcgggaaaccccagatcggacattagttcaccaatcggagtctgatcggagaaatgatcatctaacggagggatcgagatggaatcaaaatcggacggaggagggtaggtggaattagggtccggagcaggtggaggaggctgctccttggtgattggttcagccattttgaaactgagttttagggttagggtttcgaatttggggatgaagaagaagaaggagagattcaaaaggaagaaaggggttatggaggaat

SEQ ID NO: 862 - DNA, 1370 bp, Arabidopsis thaliana; identical to SEQ ID NO: 17
  G569 cDNA Sequence

SEQ ID NO: 863 - protein, 261 aa, Arabidopsis thaliana
  G569 Amino Acid Sequence
MEDGELDFSNQEVFSSSEMGELPPSNCSMDSFFDGLLMDTNAACTHTHTCNPTGPENTHTHTCFHVHTKILPDESDEKVSTDDTAESCGKKGEKRPLGNREAVRKYREKKKAKAASLEDEVARLRAVNQQLVKRLQNQATLEAEVSRLKCLLVDLRGRIDGEIGSFPYQKPMAANIPSFSHMMNPCNVQCDDEVYCPQNVFGVNSQEGASINDQGLSGCDFDQLQCMANQNLNGNGNGSFSNVNTSVSNKRKGGHRASRAV

SEQ ID NO: 864 - DNA, 985 bp, Arabidopsis thaliana
  G569 Genomic Sequence
atggaagacggtgagcttgatttctccaatcaggaagtgttttcgagttcggagatgggtgaattaccacctagcaattgttcgatggatagtttctttgatgggcttttaatggatactaatgctgcttgtacccacactcacacctgtaaccccactggaccagagaacactcatactcacacgtgcttccatgtccacaccaagattctcccggatgagagcgatgaaaaagtttctactgatgatacagctgagtcttgtgggaagaagggtgaaaagagacctttgggaaaccgggaagcggttagaaagtatagagagaagaagaaggctaaagctgcttctttggaggatgaggttgcaaggcttagggcggtgaatcagcagctggtgaagaggttgcaaaatcaggctaccttggaagctgaggtttcgaggcttaagtgtttgcttgtggatttgagaggaagaatagatggagagattggatcttttccttatcagaaacctatggctgcaaatattccttctttctcgcacatgatgaatccttgtaatgtacaatgtgatgatgaagtttattgccctcagaatgtgtttggagtgaatagccaagaaggtgcctcgatcaatgaccaagggttaagtggttgtgattttgatcagctacaatgcatggctaatcagaacttaaatggaaatggaaacggatcattcagcaacgtcaatacatctgtctcgaataagagaaaaggtgacacttttattctgtaccttagagttttctctgtaaatcgttctggtttagaaccggaggttgtttactcactctgattattggtcaactcttgccttagtatgtcttataatgtgaagcaaattcgtgacgttctcatttagtttgcctcatagaatttgtatgaactcacttatgtttttgactcatcgcttaggtgggcatcgtgcatcaagagcagtttga

SEQ ID NO: 865 - DNA, 985 bp, Arabidopsis thaliana; identical to SEQ ID NO: 864
  G569 DNA sequence used for BLAST

SEQ ID NO: 866 - DNA, 1662 bp, Arabidopsis thaliana
  G570 cDNA Sequence
aagcttgatcctcctagttgtacgaaagcttgagtaatggggtctagattaaacttcaagagctttgttgatggtgtgagtgagcagcagccaacggtggggactagtcttccattgactaggcagaactctgtgttctcgttaacctttgatgagtttcagaactcatggggtggtggaattgggaaagattttgggtctatgaacatggatgagctcttgaagaacatttggactgcagaggaaagtcattcaatgatgggaaacaataccagttacaccaacatcagcaatggtaatagtggaaacactgttattaacggcggtggtaacaacattggtgggttagctgttggtgtgggaggagaaagtggtggttttttcactggtgggagtttgcagagacaaggttcacttaccttgcctcggacgattagtcagaaaagggttgatgatgtctggaaggagctgatgaaggaggatgacattggaaatggtgttgttaatggtgggacaagcggaattccgcagaggcaacaaacgctgggagagatgactttggaggagtttttggtcagggctggtgtggttagggaagaacctcaaccggtggagagtgtaactaacttcaatggcggattctatggatttggcagtaatggaggtcttgggacagctagtaatgggtttgttgcaaaccaacctcaagatttgtcaggaaatggagtagcggtgagacaggatctgctgactgctcaaactcagccactacagatgcagcagccacagatggtgcagcagccacagatggtgcagcagccgcaacaactgatacagacgcaggagaggccttttcccaaacagaccactatagcattttccaacactgttgatgtggttaaccgttctcaacctgcaacacagtgccaggaagtgaagccttcaatacttggaattcataaccatcctatgaacaacaatctactgcaagctgtcgattttaaaacaggagtaacggttgcagcagtatctcctggaagccagatgtcacctgatctgactccaaagagcgccctggatgcatctttgtcccctgttccttacatgtttgggcgagtgagaaaaacaggtgcagttctggagaaagtgattgagagaaggcaaaaaaggatgataaagaatagggaatcagctgcaagatcccgcgctcgcaagcaagcttatacgatggaactggaagcagaaattgcgcaactcaaagaattgaatgaagagttgcagaagaaacaagttgaaatcatggaaaagcagaaaaatcagcttctggagcctctgcgccagccatggggaatgggatgcaaaaggcaatgcttgcgaaggacattgacgggtccctggtagagcttataatggcgtctaaggaacccaacaaagcgccgaagttatagaacaactcagaagatagaaagctagctttgtacgtagtttaggcaggttctgtgggtgattgtaaatcttgaagtgtggcggatttgacagagatagataaacacatatctgttctattttcctaaatcttttggttttatcttcctgatgtaatggatctttatcatttgtcttgaacatctttgtgacttaaccagagtgaatttatcttgt

SEQ ID NO: 867 - protein, 454 aa, Arabidopsis thaliana
  G570 Amino Acid Sequence
MGSRLNFKSFVDGVSEQQPTVGTSLPLTRQNSVFSLTFDEFQNSWGGGIGKDFGSMNMDELLKNIWTAEESHSMMGNNTSYTNISNGNSGNTVINGGGNNIGGLAVGVGGESGGFFTGGSLQRQGSLTLPRTISQKRVDDVWKELMKEDDIGNGVVNGGTSGIPQRQQTLGEMTLEEFLVRAGVVREEPQPVESVTNFNGGFYGFGSNGGLGTASNGFVANQPQDLSGNGVAVRQDLLTAQTQPLQMQQPQMVQQPQMVQQPQQLIQTQERPFPKQTTIAFSNTVDVVNRSQPATQCQEVKPSILGIHNHPMNNNLLQAVDFKTGVTVAAVSPGSQMSPDLTPKSALDASLSPVPYMFGRVRKTGAVLEKVIERRQKRMIKNRESAARSRARKQAYTMELEAEIAQLKELNEELQKKQVEIMEKQKNQLLEPLRQPWGMGCKRQCLRRTLTGPW

SEQ ID NO: 868 - DNA, 1964 bp, Arabidopsis thaliana
  G570 Genomic Sequence
atggggtctagattaaacttcaagagctttgttgatggtgtgagtgagcagcagccaacggtggggactagtcttccattgactaggcagaactctgtgttctcgttaacctttgatgagtttcagaactcatggggtggtggaattgggaaagattttgggtctatgaacatggatgagctcttgaagaacatttggactgcagaggaaagtcattcaatgatgggaaacaataccagttacaccaacatcagcaatggtaatagtggaaacactgttattaacggcggtggtaacaacattggtgggttagctgttggtgtgggaggagaaagtggtggttttttcactggtgggagtttgcagagacaaggttcacttaccttgcctcggacgattagtcagaaaagggttgatgatgtctggaaggagctgatgaaggaggatgacattggaaatggtgttgttaatggtgggacaagcggaattccgcagaggcaacaaacgctgggagagatgactttggaggagtttttggtcagggctggtgtggttagggaagaacctcaaccggtggagagtgtaactaacttcaatggcggattctatggatttggcagtaatggaggtcttgggacagctagtaatgggtttgttgcaaaccaacctcaagatttgtcaggaaatggagtagcggtgagacaggatctgctgactgctcaaactcagccactacagatgcagcagccacagatggtgcagcagccacagatggtgcagcagccgcaacaactgatacagacgcaggagaggccttttcccaaacagaccactatagcattttccaacactgttgatgtggttaaccgttctcaacctgcaacacaggtgactaaagaacctaagctactacattttgtaggaaatacaatcatctgaaaaatattagacgtagccttcatgttttaagataagctggttttggatatgcatgtatgtttcagttatctgagcatgacttgtttttacttttttcgcagtgccaggaagtgaagccttcaatacttggaattcataaccatcctatgaacaacaatctactgcaagctgtcgattttaaaacaggagtaacggttgcagcagtatctcctggaagccagatgtcacctgatctgactccaaagagcgccctggatgcatctttgtcccctgttccttacatgtttgggcgagtgagaaaaacaggtgcagttctggagaaagtgattgagagaaggcaaaaaaggatgataaagaatagggaatcagctgcaagatcccgcgctcgcaagcaagtgagtgtttgtttaaattttggagattaaagaaaccttaaaactgtgaccatgttatttactttttcactttcttgcttgacaggcttatacgatggaactggaagcagaaattgcgcaactcaaagaattgaatgaagagttgcagaagaaacaagtgtgtctcgcttcttccctatcacaattaagaatctcgagattttcatattttcttgaggttgtattcactgaccaaatgtttcatgcaggttgaaatcatggaaaagcagaaaaatcaggtactgtcttgatttgaatatcctctatggttgttggctaggcttttaactctcactcataatgaattacacttttggacagtattctaagcttttgagtagaatagtgtaagctataccatgaagtgagacatatcatcacatttttgatttcccactctgcataaagtatttaagatttgtgaatatgttgcaatgccaatttggatatttcatgagactaatctgacgagcatggatttaacggaagttggctcatttgttgttgcagcttctggagcctctgcgccagccatggggaatgggatgcaaaaggcaatgcttgcgaaggacattgacgggtccctggtag

SEQ ID NO: 869 - DNA, 1964 bp, Arabidopsis thaliana; identical to SEQ ID NO: 868
  G570 DNA sequence used for BLAST

SEQ ID NO: 870 - DNA, 1888 bp, Arabidopsis thaliana; identical to SEQ ID NO: 53
  G571 cDNA Sequence

SEQ ID NO: 871 - protein, 460 aa, Arabidopsis thaliana
  G571 Amino Acid Sequence
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 872 - DNA, 5119 bp, Arabidopsis thaliana
  G571 DNA sequence used for BLAST
agacccatcactcttcctctatcttgatggacaaggacatcatgatcctccatcaactgctccttctcctttacatcatcatcacacaactcgtatgcactctctctctctctcttttctttcttttttgggaattggggtttgtttttttggtttcagcagataaggaagattccctttaggtgtgtgagagagagagagagtcacagcaaaagcatgccaaacagatttcaatctttcttctgccatcagtactctattctttcagctttgaccagatcctctctcttttcagacaccaaatctttcaaatccatatatcttacacttctttaaacccttttctctctctgtcctttttcttctaattagaagaactagtccgctcacatatttatatacatgacttgttataactagaccatttctcatacatatggtcacatgactcatcttatggcagagaatttggcgatgagacctccaacatcgacgctcaacatctttccatctcagcctatgcacatagagccacctccttcttctacacacaatgtaataattattactattactttataaatttctatatatatatgccaattttagttggtttctgtttctaatttaatataatgtcagcgcaactactagccatttcatataatatcaagtcagaccaattattatacgtttcttatttttctattgagtagtgatttgattgttttttggttgttttatataatgtgtttggtaagaccgataatacaagattagttccggctgctcaacctagtggttccactcgaccagcttctgacccgtccatggacttgaccaatcattctcagtttcatcaacctcctcaaggttctaaatccatcaaggtctctatccatttatgtttttttaatcatttaattgctttgtcgaactataactcgagtatagatatagacttgttgtggttgtttttagaagttaatgggtcatatctaaatgttatggcagaaggaagggaaccgcaagggtcttgcctcatcggaccatgacatacctaaatcgtcagaccctaaagtgagtgtatattcatacaactgcagaaaattaataagattcttttttttttttttttttttacttttcggtttttgatagtttctttattaatttaattctcaacagacattgagaagactagcacaaaacagagaagcagcaagaaaaagcagattacgtaaaaaggtcagcattcaatatttgtaagttgcaaatatagtttttatatccaaatttatttataacgttatttgctttggtaaattacgacaggcttatgttcagcaactcgagtcatgtaggatcaaactgacccaactagaacaagagattcaacgggccagatcccaagtaaatatttgaacctgtcttttcatatatattgtatttaacctaaagtctaaaatgtaccaatttaatttgatttcctatatatgtttagggcgtattctttggagggtctcttataggaggagatcaacagcaaggtggactacccattggccctggcaacatcagctctggtacgttaatagtttcataaatgtgatgactcaaaaaccgtaaaatttgaaaaccgagagaatgagatattgagtaaatgcaatgtgaagcagaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtacatctcgtcttttcttatagccatatacatatatttaggtttttcgagagatatttacttattctattcgagccacatcccacacaataattagtcatgatgatattgtaaactaatcaaatatggattaataaatctaaattttggaattttacttgaagactaatcattttaaattttatcttagaacctaaaatattccaggatacaatcattaataccatcaattttgtggattacttgcagaacatatactaataatgactgaaattgtgacattgttattatttatatcgtacatatatgtccacagaatatagtacttccaactttattttattatttagatttttttttttaatttagtctttgattctcgtaaaagaggtacgatatagtaataatagataagacagacaagagatagactatatagtgatattgttggacgaggtatatatatacataacattgcatggggtgactctagatgtataaaaccaacatatatacgtgaatgtctttatattacgacaataataaaggtacacgtaaaattattttgaaaacaaattaagaatgcatgcaattgtgtgtgatggtgaagtatctctagaaataggtaggttttggcataatgcaaaagaaagtgcctgtctgttttttcgatttatgggatccataggagagagagatagacataaaccaccatggaattcaacagagacgaccataataaacaaaccaaaaataaataattgtttaacatttttagcacgctcgtcaattggatgattatcattttttttcttttctaaaatggttacgtaaagccattttaattaaacctactttttattctaaacaatatgagtacctacgatagccgattaataatacaaattaatatatggatggtgtgcatatctgacaagacctttggcaatgtctcaatcttatatcctttttagtgaaaataaaaaggaaagaagagattttgggtgtagctagtaactcgtgcagagtacatacactacacactttaatgcattcaacgttctttatgcatccattaagaccattgttaattaatcctcgatatctcaacttgtgtgtattaattagaaacgcatgcatgcaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggtacccttataactctttctttttaagtttatgtgcaattatatatcaatataccaatcttttatctttatataaaaatatacctatagagttgatatacaagtggacccctagaggatatatgtggtcctaatcagactaggaatacatattctgtttctttgaactactccttattaaactcaactatcatatacttatatatttctatatttggctgttataacacgctatctaaatttatatagatgtttgtatatatgtgtgtgtctgttttgtgtacaactcatatataggtataacgtcggccataatttgttagaggacatttgtaatatattaagtgtatatagaataaaagtggttgattttaaagaagatgtcaaaactaattcgcaaacttaataattatgcattaacatgtatatgtatatgaaatggaaagtatttgcctcttgattcggacattatgcaagtaggtatctaacaaacacttctcttgtcttatatcaacttggtcgggttgcttttcttagacgaccaagtttattaatttaatatttatttcttaatcatttactagtttaggacaggcaagtttttgaaacaaagaaatatatatatctgcttgtgtatattaatgtataagtctatactctatatgcaaatggacatttcggctaattaattctatacaagatacatgcatatacaagttggcatctttcaatgatttcttaatataattagttctaaattgttcctgttccgcctataaaaaaagtttttgtgtttcgctacacggttagtcgctcacaatttggagaaagatccaactttaaaataggtggtaaatgtggggttagttactaaaaaggggtaatgaattcaattttctctaaacgcacgtgacaattggcaccatgaaagtatgtattaagtatacatattccaatatatgtagtccaaaagaaaaatacatatattatgtatctataatatatcacatcaaataaaaacatggaatgcttggagcccatatcgttgcatgatgtcatggacgtaactgcccaagtatcccatcctccgaaaacacttccttgagaataattcctttacttacatttgattctgcatttttttgtctacttttatatcattgataataggttgattatatatgtatgattctaattaatgatcaaaagtatcatgaagcatggcgtgggaccgagggtatggaattcacggtttcacctttttgacatgttggtgtcgtgttcttattagtgaattactaacaagctttgattttttgatcgatcaacatgttgaataatcggcattagtcgtcaatcaaccacataatttcgggtcatgcacaatcattataatgcttaattagtcctttatctgtttttttcctctctagttagtctttaatacttatatttatgagattaatgatggtccaattcgattatttgtccttaattggtcttagtcaataacatgtgcactactttgtccatcttttgttttgcttttactatttctccattttccctataactcttatttagttttgaactagctaatacattagaaacttacaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataa

SEQ ID NO: 873 - DNA, 1104 bp, Arabidopsis thaliana
  G572 cDNA Sequence
aggtaaccatggtccacaattgtccccctactagtctatatgaacacctcttctcaccacacacaccaaacattcatcacaattccctaaatcctacaatctttcttttcttccatcacctaagagtaaaccctaccttgcgtcccaagtctccaccgataatgcaaccatccaccaacatttttagcctccatggttgtccaccttcgtacctttcccatattcctacatcctcaccattttgcggacaaaaccctaatccattcttcagcttcgaaactggcgtgaacacttcacagttcatgagtttgatcagcagcaacaactcgacctcagatgaagcagaagagaatcataaggagataataaatgagaggaagcaaaagaggaagatatctaacagagaatcggcaagaagatcgcgtatgaggaagcagagacaagtggatgagctttggtcacaggtgatgtggcttagggatgagaatcatcagctgcttcgtaagcttaactgcgttttagagtctcaagagaaggttattgaagagaatgttcagctcaaagaggaaaccactgagcttaagcaaatgattagtgatatgcagcttcagaatcagagtcctttctcttgcatcagagacgacgacgacgttgtatagatgatttttatttttatttttttggggctctagtatgtatcaacaaatgtatatccagagatctgtctcagcttaagatttaattaagactctaaattagtaattgttaaagcagagttcttcaaacttgtgttgcccgtgaatagaagtaagaaattgtttcacaattgtttgcataacaaacgataaaaattcacattgctgaagtataattttaaaaaaaattacatgcataaatatttttgcaaaatgtaaatacaagcatcaattactaacagtagactttcttctttttctctttaaaattttacgtttataatgaccaattttgttctttctaaattggcttaagtagtgtctttgaaaaaaatatacaccagccgtaaacggtttattttcttccatttccatttgcatttttatgttgaaaaattattaagaaaag

SEQ ID NO: 874 - protein, 216 aa, Arabidopsis thaliana
  G572 Amino Acid Sequence
MVHNCPPTSLYEHLFSPHTPNIHHNSLNPTIFLFFHHLRVNPTLRPKSPPIMQPSTNIFSLHGCPPSYLSHIPTSSPFCGQNPNPFFSFETGVNTSQFMSLISSNNSTSDEAEENHKEIINERKQKRKISNRESARRSRMRKQRQVDELWSQVMWLRDENHQLLRKLNCVLESQEKVIEENVQLKEETTELKQMISDMQLQNQSPFSCIRDDDDVV

SEQ ID NO: 875 - DNA, 651 bp, Arabidopsis thaliana
  G572 Genomic Sequence
atggtccacaattgtccccctactagtctatatgaacacctcttctcaccacacacaccaaacattcatcacaattccctaaatcctacaatctttcttttcttccatcacctaagagtaaaccctaccttgcgtcccaagtctccaccgataatgcaaccatccaccaacatttttagcctccatggttgtccaccttcgtacctttcccatattcctacatcctcaccattttgcggacaaaaccctaatccattcttcagcttcgaaactggcgtgaacacttcacagttcatgagtttgatcagcagcaacaactcgacctcagatgaagcagaagagaatcataaggagataataaatgagaggaagcaaaagaggaagatatctaacagagaatcggcaagaagatcgcgtatgaggaagcagagacaagtggatgagctttggtcacaggtgatgtggcttagggatgagaatcatcagctgcttcgtaagcttaactgcgttttagagtctcaagagaaggttattgaagagaatgttcagctcaaagaggaaaccactgagcttaagcaaatgattagtgatatgcagcttcagaatcagagtcctttctcttgcatcagagacgacgacgacgttgtatag

SEQ ID NO: 876 - DNA, 651 bp, Arabidopsis thaliana
  G572 DNA sequence used for BLAST
ctatacaacgtcgtcgtcgtctctgatgcaagagaaaggactctgattctgaagctgcatatcactaatcatttgcttaagctcagtggtttcctctttgagctgaacattctcttcaataaccttctcttgagactctaaaacgcagttaagcttacgaagcagctgatgattctcatccctaagccacatcacctgtgaccaaagctcatccacttgtctctgcttcctcatacgcgatcttcttgccgattctctgttagatatcttcctcttttgcttcctctcatttattatctccttatgattctcttctgcttcatctgaggtcgagttgttgctgctgatcaaactcatgaactgtgaagtgttcacgccagtttcgaagctgaagaatggattagggttttgtccgcaaaatggtgaggatgtaggaatatgggaaaggtacgaaggtggacaaccatggaggctaaaaatgttggtggatggttgcattatcggtggagacttgggacgcaaggtagggtttactcttaggtgatggaagaaaagaaagattgtaggatttagggaattgtgatgaatgtttggtgtgtgtggtgagaagaggtgttcatatagactagtagggggacaattgtggaccat

SEQ ID NO: 877 - DNA, 1210 bp, Arabidopsis thaliana
  G573 cDNA Sequence
catttggcggagtcaaagaaacagagtgattctctgatccgattccggcgaaagaggacgaaacaaacggaacttgttcatcatcttctccagaaatgacgtcgtttcaggtgatgcgttcttcaaattcgagaaactcggatctatctcgtcgcatctcttctgcttctacttcttcttcgtctataagacctcaacaacagttccggcgagatctaacaagtgtcggttacggcggaagaaacgacggattatacagttcaaattcgatgacggtcgaagggattttacacgatactttcgcatcagatccaccagcaccaacggaatcttcactcttagatgcgtcgataaatctgatggatgcttctccagcaccaatggagataacaacaacgacggcttctgatgttgtggatcacggcggaggaacggagacgacgcgtggtgggaagagtgttgatgagatttggagagagatggtatcagtagaaggtaaagggatggaagagacgtcggaagagataatgacgttagaggattttctagcgaaagctgcggtggaagacgaaacagcggtgacggcgtcggcggaggatttggatgtgaagattccggtgacgaattacggattcgatcattctgcaccgccgcataatccgtttcagatgattgataaagtagaaggatcaatagttgcgtttgggaatggtttagatgtttacggaggaggagctagagggaagagagcgagagtgatggttgagccattggataaagcagctgcacagagacagagaaggatgattaagaatcgtgaatctgcagctaggtctagagagaggaaacaagcttatcaagttgagttagaagctttggctgcgaagcttgaggaagagaatgagttgctttctaaggagattgaagataagaggaaagagagataccagaagttgatggagtttgtgattcctgttgttgagaaaccgaagcagcagccaccacggtttttacgcaggattcggtctttggaatggtgataagaggtatagacttttgaggattttagggtcttaatgttacttactttgtgtatgtgtgtgtgagagttgattcataatctgcagtagagtgtaatgattatggttaataacttatatattatattagattgcatatgttattggttttgctgaaaaaaaaaaaaaaa

SEQ ID NO: 878 - protein, 314 aa, Arabidopsis thaliana
  G573 Amino Acid Sequence
MTSFQVMRSSNSRNSDLSRRISSASTSSSSIRPQQQFRRDLTSVGYGGRNDGLYSSNSMTVEGILHDTFASDPPAPTESSLLDASINLMDASPAPMEITTTTASDVVDHGGGTETTRGGKSVDEIWREMVSVEGKGMEETSEEIMTLEDFLAKAAVEDETAVTASAEDLDVKIPVTNYGFDHSAPPHNPFQMIDKVEGSIVAFGNGLDVYGGGARGKRARVMVEPLDKAAAQRQRRMIKNRESAARSRERKQAYQVELEALAAKLEEENELLSKEIEDKRKERYQKLMEFVIPVVEKPKQQPPRFLRRIRSLEW

SEQ ID NO: 879 - DNA, 945 bp, Arabidopsis thaliana
  G573 Genomic Sequence
atgacgtcgtttcaggtgatgcgttcttcaaattcgagaaactcggatctatctcgtcgcatctcttctgcttctacttcttcttcgtctataagacctcaacaacagttccggcgagatctaacaagtgtcggttacggcggaagaaacgacggattatacagttcaaattcgatgacggtcgaagggattttacacgatactttcgcatcagatccaccagcaccaacggaatcttcactcttagatgcgtcgataaatctgatggatgcttctccagcaccaatggagataacaacaacgacggcttctgatgttgtggatcacggcggaggaacggagacgacgcgtggtgggaagagtgttgatgagatttggagagagatggtatcagtagaaggtaaagggatggaagagacgtcggaagagataatgacgttagaggattttctagcgaaagctgcggtggaagacgaaacagcggtgacggcgtcggcggaggatttggatgtgaagattccggtgacgaattacggattcgatcattctgcaccgccgcataatccgtttcagatgattgataaagtagaaggatcaatagttgcgtttgggaatggtttagatgtttacggaggaggagctagagggaagagagcgagagtgatggttgagccattggataaagcagctgcacagagacagagaaggatgattaagaatcgtgaatctgcagctaggtctagagagaggaaacaagcttatcaagttgagttagaagctttggctgcgaagcttgaggaagagaatgagttgctttctaaggagattgaagataagaggaaagagagataccagaagttgatggagtttgtgattcctgttgttgagaaaccgaagcagcagccaccacggtttttacgcaggattcggtctttggaatggtga

SEQ ID NO: 880 - DNA, 948 bp, Arabidopsis thaliana
  G573 DNA sequence used for BLAST
tcaccattccaaagaccgaatcctgcgtaaaaaccgtggtggctgctgcttcggtttctcaacaacaggaatcacaaactccatcaacttctggtatctctctttcctcttatcttcaatctccttagaaagcaactcattctcttcctcaagcttcgcagccaaagcttctaactcaacttgataagcttgtttcctctctctagacctagctgcagattcacgattcttaatcatccttctctgtctctgtgcagctgctttatccaatggctcaaccatcactctcgctctcttccctctagctcctcctccgtaaacatctaaaccattcccaaacgcaactattgatccttctactttatcaatcatctgaaacggattatgcggcggtgcagaatgatcgaatccgtaattcgtcaccggaatcttcacatccaaatcctccgccgacgccgtcaccgctgtttcgtcttccaccgcagctttcgctagaaaatcctctaacgtcattatctcttccgacgtctcttccttcatccctttaccttctcctgataccatctctctccaaatctcatcaacactcttcccaccacgcgtcgtctccgttcctccgccgtgatccacaacatcagaagccgtcgttgttgttatctccattggtgctggagaagcatccatcagatttatcgacgcatctaagagtgaagattccgttggtgctggtggatctgatgcgaaagtatcgtgtaaaatcccttcgaccgtcatcgaatttgaactgtataatccgtcgtttcttccgccgtaaccgacacttgttagatctcgccggaactgttgttgaggtcttatagacgaagaagaagtagaagcagaagagatgcgacgagatagatccgagtttctcgaatttgaagaacgcatcacctgaaacgacgtcat

SEQ ID NO: 881 - DNA, 976 bp, Arabidopsis thaliana
  G575 cDNA Sequence
acttacttagtgagtactccaaacataagaaacatgccaaacactagcagctctcaaagcttcactatcttcgttgatggttggttaatccgtcacaggtatttcgttgaacagcttatgtgtgcttcttccttggatgaaactaatcgtatctctctcgaagaacaacaatctctcgtggcccagtttctatctcactgtcttcaatactaccaagagaaattcgcctccgtttccctcgccggggacaacgttttcactttcttctgcccaccgtggtttaactcctacgctaaacttattttatgggtcggcgatttcaagccttctcttgtgtttaaactcaccgaggtctccgtggccgacctcacgcgccaccagaaagaccggatctcgagtcttaagtcggagactaggaggaaagagagagaagttatgcgagatttcgccctcgtgcaacaaagcgtggcggatccgccggtgatgctcgcggcgaggcgcgtgggagcggtgggaatggtggacggagaagaaacggatttggaggaggcgatggaggtgcttaaagctgggatggcggcagcgatgaacaacgctgatcagctacggtgttcgacggtggggaaagtggtggagattcttactccgccgcaagcgattaaagtgttgaggcacaatcggacagcttcacctccgtctgagagacagagaccaagaaagagcttaaaaaaaaagatacttaatttgctttgctctgcttcttcaacaacgatggagtcatcactaatttttgtttttcgggctcaaccacttgatcctgagatttagatttccttttggtgatttatgatttttaaaagatttgagaattgggcttttttgtttgtagtgatatgatgtcatgttttttatttttggcttctcgtttcttccttaaatcagttcttactaaatctcatcagttacttttacaatc

SEQ ID NO: 882 - protein, 264 aa, Arabidopsis thaliana
  G575 Amino Acid Sequence
MPNTSSSQSFTIFVDGWLIRHRYFVEQLMCASSLDETNRISLEEQQSLVAQFLSHCLQYYQEKFASVSLAGDNVFTFFCPPWFNSYAKLILWVGDFKPSLVFKLTEVSVADLTRHQKDRISSLKSETRRKEREVMRDFALVQQSVADPPVMLAARRVGAVGMVDGEETDLEEAMEVLKAGMAAAMNNADQLRCSTVGKVVEILTPPQAIKVLRHNRTASPPSERQRPRKSLKKKILNLLCSASSTTMESSLIFVFRAQPLDPEI

SEQ ID NO: 883 - DNA, 794 bp, Arabidopsis thaliana
  G575 Genomic Sequence
atgccaaacactagcagctctcaaagcttcactatcttcgttgatggttggttaatccgtcacaggtatttcgttgaacagcttatgtgtgcttcttccttggatgaaactaatcgtatctctctcgaagaacaacaatctctcgtggcccagtttctatctcactgtcttcaatactaccaagagaaattcgcctccgtttccctcgccggggacaacgttttcactttcttctgcccaccgtggtttaactcctacgctaaacttattttatgggtcggcgatttcaagccttctcttgtgtttaaactcaccgaggtctccgtggccgacctcacgcgccaccagaaagaccggatctcgagtcttaagtcggagactaggaggaaagagagagaagttatgcgagatttcgccctcgtgcaacaaagcgtggcggatccgccggtgatgctcgcggcgaggcgcgtgggagcggtgggaatggtggacggagaagaaacggatttggaggaggcgatggaggtgcttaaagctgggatggcggcagcgatgaacaacgctgatcagctacggtgttcgacggtggggaaagtggtggagattcttactccgccgcaagcgattaaagtgttgaggacaatcggacagcttcacctccgtctgagagacagagaccaagaaagagcttaaaaaaaaagatacttaatttgctttgctctgcttcttcaacaacgatggagtcatcactaatttttgtttttcgggctcaaccacttgatcctgagatttag

SEQ ID NO: 884 - DNA, 794 bp, Arabidopsis thaliana
  G575 DNA sequence used for BLAST
ctaaatctcaggatcaagtggttgagcccgaaaaacaaaaattagtgatgactccatcgttgttgaagaagcagagcaaagcaaattaagtatctttttttttaagctctttcttggtctctgtctctcagacggaggtgaagctgtccgattgtcctcaacactttaatcgcttgcggcggagtaagaatctccaccactttccccaccgtcgaacaccgtagctgatcagcgttgttcatcgctgccgccatcccagctttaagcacctccatcgcctcctccaaatccgtttcttctccgtccaccattcccaccgctcccacgcgcctcgccgcgagcatcaccggcggatccgccacgctttgttgcacgagggcgaaatctcgcataacttctctctctttcctcctagtctccgacttaagactcgagatccggtctttctggtggcgcgtgaggtcggccacggagacctcggtgagtttaaacacaagagaaggcttgaaatcgccgacccataaaataagtttagcgtaggagttaaaccacggtgggcagaagaaagtgaaaacgttgtccccggcgagggaaacggaggcgaatttctcttggtagtattgaagacagtgagatagaaactgggccacgagagattgttgttcttcgagagagatacgattagtttcatccaaggaagaagcacacataagctgttcaacgaaatacctgtgacggattaaccaaccatcaacgaagatagtgaagctttgagagctgctagtgtttggcat

SEQ ID NO: 885 - DNA, 1400 bp, Arabidopsis thaliana
  G579 cDNA Sequence
aaagcaagcaacagaataaattcttctccttttcttttttgttgcaactagtgaaagagaaagagacgatcgcttattttcttcttctcctacactctgcgtttttgctctctttttactccgcattgctcctccgttactatcttcgccggcgaaaatttgttttctttttccctggaggtaaattcgaatcatgtcaaggcctgctccgcttccacctcgttgcccgattccaaagaaactttctttgagtccagttgcagatacattctactcttcttcctcacccattgaatcatacattggtcaatacaagtcttctactcaagattccaggctcgaagatcaacctgcttggcttgatgagttgctctgtgacaaaactgatgggttgctcactagaggaggtcctctgcgccgctcagctagcgactcagttgtgcttttgggagacatttctgctactttttctggttttgatcaaagtgaggatgaagaaagtttgagttctgaagcttgtggggacttggagtctgcttgtgtatatggtcccaactcgccaagagcaaagaacaactctagcttctctaacaaccctattgcttctgccttttcggattatggttctcagacaccgcctcagaacttggatgatacggtgaaagggatcaaccgttcacctgttgctgaaaatgcgtgtggttcaatgggcataccaaatgcaaaaaggaacccgggacagcgttcaagggttcgtaagctccagtacattgctgaacttgagagaacagtaggcatgttgcagacggtggaagcagatttatcagtgagagtggcttcacttcttcagacacgagcaacactgtccctggagaatagccagttgaagcagcagatggcgatactaaagcaggacaagctcataagggaaggtgagtatcagttactgaagaaggaagctcagagattgaaatctggattgggatacttagggagcactaacaacagtaacaggctggtgaggtcatattctgctggttcaaatgtagctccaaggacagcttcgtcccacttggactggaatttgctagatctgaccaaactcaatctcaactaaagacaaaaccctccataagaataagtagcttaaggaattcaagagttaacagttctatgttcggaaaatgaacaaatctttgtcgatttgtataaatatgatttaggagtataaagtatcccactgtcttgggatgtagtcttttttagctaaaatgctctgatattggagacattttaagggttcctattttgtagctcattgagtaattgtggtggctttgactgagagtattcttctatttctggtgttctaaaaagctattaatttgatgaacgttggg

SEQ ID NO: 886 - protein, 307 aa, Arabidopsis thaliana
  G579 Amino Acid Sequence
MSRPAPLPPRCPIPKKLSLSPVADTFYSSSSPIESYIGQYKSSTQDSRLEDQPAWLDELLCDKTDGLLTRGGPLRRSASDSVVLLGDISATFSGFDQSEDEESLSSEACGDLESACVYGPNSPRAKNNSSFSNNPIASAFSDYGSQTPPQNLDDTVKGINRSPVAENACGSMGIPNAKRNPGQRSRVRKLQYIAELERTVGMLQTVEADLSVRVASLLQTRATLSLENSQLKQQMAILKQDKLIREGEYQLLKKEAQRLKSGLGYLGSTNNSNRLVRSYSAGSNVAPRTASSHLDWNLLDLTKLNLN

SEQ ID NO: 887 - DNA, 1644 bp, Arabidopsis thaliana
  G579 Genomic Sequence
atgtcaaggcctgctccgcttccacctcgttgcccgattccaaagaaactttctttgagtccagttgcagatacattctactcttcttcctcacccattgaatcatacattggtcaatacaagtcttctactcaagattccaggctcgaagatcaacctgcttggcttgatgagttgctctgtgacaaaactgatgggttgctcactagaggaggtcctctgcgccgctcagctagcgactcagttgtgcttttgggagacatttctgctactttttctggttttgatcaaagtgaggatgaagaaagtttgagttctgaagcttgtggggacttggagtctgcttgtgtatatggtcccaactcgccaagagcaaagaacaactctagcttctctaacaaccctattgcttctgccttttcggattatggttctcagacaccgcctcagaacttggatgatacggtgaaagggatcaaccgttcacctgttgctgaaaatgcgtgtggttcaatgggcataccaaatgcaaaaaggtgagagaacattaatcttcttaagacattattatttaacatcattactttatttgtgtagaaattgataagctttggtcccttaagagtagtattctttatcggctaatgttgctaatattaattcggctgcatcaagtctagtccataagctcctatgtggtacctctgtgtctattctagatcaagatacatcggtttctggtttgtcagtgagaaggaagaaaagaatagttccatatctctgttttacacttggatttgtagttggtggggattcttatgactactaaattggcagaaatatgtgtctgtgtccacaagagtgctcttagaatgccaattcggtacttttacattatcttgttgtgtcatatgttgatttttctatctttactctgccaggaacccgggacagcgttcaagggttcgtaagctccagtacattgctgaacttgagagaacagtaggcatgttgcaggtagagattccattcaagctgtgcgctttcttaaaacacaatcgttattttttctgtggacagttatatgtacaaaatgcaatgttgtatgttagatctctgtggtaagatgatctagttgttggtgttactacatagttagatgcagagcagtaaaacattatacagaaacctagcacattgtttttggtagtaaccaaatagcaatctcgttttgcagacggtggaagcagatttatcagtgagagtggcttcacttcttcagacacgagcaacactgtccctggagaatagccagttgaagcagcagatggcgatactaaagcaggacaagctcataagggaaggtaaataaaaacatgacataaaccacacattcaaggagtctgaattacagcttgtgatcgatccactgatgcttgttccgaaatattttctgtaggtgagtatcagttactgaagaaggaagctcagagattgaaatctggattgggatacttagggagcactaacaacagtaacaggctggtgaggtcatattctgctggttcaaatgtagctccaaggacagcttcgtcccacttggactggaatttgctagatctgaccaaactcaatctcaactaa

SEQ ID NO: 888 - DNA, 1644 bp, Arabidopsis thaliana; identical to SEQ ID NO: 887
  G579 DNA sequence used for BLAST

SEQ ID NO: 889 - DNA, 1544 bp, Arabidopsis thaliana
  G582 cDNA Sequence
cttttacacaacaaactcctgcagccatagtgtcctcttctcctccggatttagtacttcaacaaaaactccggtttgtcgtggaaacctcaccggaccgatgggcttatgtcattttttggcaaaagatgtttgatgatcaatcggaccggtcttacttggtttgggttgatggtcatttctgtggaaacaagaacaacaattcccaagaaaatgttcatttttctttgcctcttatgttatctaatcaaaatatccaaaatttatttaaatcaacttcttaaaaaagttctattaagaaaataatataattttccttacccttgattttttgtttttgtttctttcttaagtatacaacaaacagcatcgagtgtgagctgatgatggacggtggagatgatctggagttgttctatgccgcatcgttttacggtgaagatagatcgccgagaaaggaagtatccgatgaatctttggtttggttaaccggtcccgacgagctccggtttagcaactacgagagggctaaagaagccggttttcacggggtacacacattggtctccatacccatcaacaatggcattatcgaacttggttcgtctgaatcaattatacaaaaccggaactttataaaccgagtcaagtccatattcgggtcgggtaaaacaacaaaacacactaaccaaaccggttcttaccctaaaccggcggtatcagatcattcgaaaagcggaaatcagcaattcgggtcggaaagaaaacggaggaggaaacttgagacgacaagggtagctgcggcgacgaaagagaaacatcatccggcggttttgtcccacgtggaagcggagaagcaacggagagagaagctaaaccaccggttttacgctctacgtgccatcgtaccaaaagtgtcacgaatggacaaagcgtcacttttatccgacgcagtttcgtacatagaaagtcttaaatccaaaatcgatgatctcgaaactgagatcaagaaaatgaagatgacggagacagataaattagacaacagcagcagcaatacgtctccgtcttccgttgagtaccaagttaaccagaaaccttcaaaatcaaacagaggctctgacttggaagtgcaagtgaagatcgtcggagaagaagccataattagggttcagacagagaatgtgaaccatcctacgtcggcattgatgagtgcgttaatggaaatggattgtcgtgtacaacacgcgaacgcgtcgcgcttgagtcaggttatggttcaagatgttgttgttttggttccagaaggattaagatcggaagataggcttaggaccacacttgtccgaaccctaagcctataacaatttctttgttttgtgacgtcaacataggatgtgataataatttttgtttttttttgcgaccttttgttttatttgataagtactagaaaaatcaaattccttctagcgattaatgttgttttatcaaaagtttgatctcgttgatacgtagtttatgtgttacttttttactttaaa

SEQ ID NO: 890 - protein, 326 aa, Arabidopsis thaliana
  G582 Amino Acid Sequence
MMDGGDDLELFYAASFYGEDRSPRKEVSDESLVWLTGPDELRFSNYERAKEAGFHGVHTLVSIPINNGIIELGSSESIIQNRNFINRVKSIFGSGKTTKHTNQTGSYPKPAVSDHSKSGNQQFGSERKRRRKLETTRVAAATKEKHHPAVLSHVEAEKQRREKLNHRFYALRAIVPKVSRMDKASLLSDAVSYIESLKSKIDDLETEIKKMKMTETDKLDNSSSNTSPSSVEYQVNQKPSKSNRGSDLEVQVKIVGEEAIIRVQTENVNHPTSALMSALMEMDCRVQHANASRLSQVMVQDVVVLVPEGLRSEDRLRTTLVRTLSL

SEQ ID NO: 891 - DNA, 981 bp, Arabidopsis thaliana
  G582 Genomic Sequence
atgatggacggtggagatgatctggagttgttctatgccgcatcgttttacggtgaagatagatcgccgagaaaggaagtatccgatgaatctttggtttggttaaccggtcccgacgagctccggtttagcaactacgagagggctaaagaagccggttttcacggggtacacacattggtctccatacccatcaacaatggcattatcgaacttggttcgtctgaatcaattatacaaaaccggaactttataaaccgagtcaagtccatattcgggtcgggtaaaacaacaaaacacactaaccaaaccggttcttaccctaaaccggcggtatcagatcattcgaaaagcggaaatcagcaattcgggtcggaaagaaaacggaggaggaaacttgagacgacaagggtagctgcggcgacgaaagagaaacatcatccggcggttttgtcccacgtggaagcggagaagcaacggagagagaagctaaaccaccggttttacgctctacgtgccatcgtaccaaaagtgtcacgaatggacaaagcgtcacttttatccgacgcagtttcgtacatagaaagtcttaaatccaaaatcgatgatctcgaaactgagatcaagaaaatgaagatgacggagacagataaattagacaacagcagcagcaatacgtctccgtcttccgttgagtaccaagttaaccagaaaccttcaaaatcaaacagaggctctgacttggaagtgcaagtgaagatcgtcggagaagaagccataattagggttcagacagagaatgtgaaccatcctacgtcggcattgatgagtgcgttaatggaaatggattgtcgtgtacaacacgcgaacgcgtcgcgcttgagtcaggttatggttcaagatgttgttgttttggttccagaaggattaagatcggaagataggcttaggaccacacttgtccgaaccctaagcctataa

SEQ ID NO: 892 - DNA, 1410 bp, Arabidopsis thaliana
  G582 DNA sequence used for BLAST
atgtataatctcactttctctccatcattgtcctcttctttgctctcttttacacaacaaactcctgcagccatagtgtcctcttctcctccggatttagtacttcaacaaaaactccggtttgtcgtggaaacctcaccggaccgatgggcttatgtcattttttggcaaaagatgtttgatgatcaatcggaccggtcttacttggtttgggttgatggtcatttctgtggaaacaagaacaacaattcccaagaaaatgttcatttttctttgcctcttatgttatctaatcaaaatatccaaaatttatttaaatcaacttcttaaaaaagttctattaagaaaataatataattttccttacccttgattttttgtttttgtttctttcttaagtatacaacaaacagcatcgagtgtgagctgatgatggacggtggagatgatctggagttgttctatgccgcatcgttttacggtgaagatagatcgccgagaaaggaagtatccgatgaatctttggtttggttaaccggtcccgacgagctccggtttagcaactacgagagggctaaagaagccggttttcacggggtacacacattggtctccatacccatcaacaatggcattatcgaacttggttcgtctgaatcaattatacaaaaccggaactttataaaccgagtcaagtccatattcgggtcgggtaaaacaacaaaacacactaaccaaaccggttcttaccctaaaccggcggtatcagatcattcgaaaagcggaaatcagcaattcgggtcggaaagaaaacggaggaggaaacttgagacgacaagggtagctgcggcgacgaaagagaaacatcatccggcggttttgtcccacgtggaagcggagaagcaacggagagagaagctaaaccaccggttttacgctctacgtgccatcgtaccaaaagtgtcacgaatggacaaagcgtcacttttatccgacgcagtttcgtacatagaaagtcttaaatccaaaatcgatgatctcgaaactgagatcaagaaaatgaagatgacggagacagataaattagacaacagcagcagcaatacgtctccgtcttccgttgagtaccaagttaaccagaaaccttcaaaatcaaacagaggctctgacttggaagtgcaagtgaagatcgtcggagaagaagccataattagggttcagacagagaatgtgaaccatcctacgtcggcattgatgagtgcgttaatggaaatggattgtcgtgtacaacacgcgaacgcgtcgcgcttgagtcaggttatggttcaagatgttgttgttttggttccagaaggattaagatcggaagataggcttaggaccacacttgtccgaaccctaagcctataa

SEQ ID NO: 893 - DNA, 2162 bp, Arabidopsis thaliana; identical to SEQ ID NO: 44
  G584 cDNA Sequence

SEQ ID NO: 894 - protein, 589 aa, Arabidopsis thaliana
  G584 Amino Acid Sequence
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 895 - DNA, 1770 bp, Arabidopsis thaliana
  G584 Genomic Sequence
tcatggacattctccaactttctccgttagagcaaccttgagttgatcttgcgtgaaaaactgattccccattttcacagtcgcttgttggatcataagatcattcactaccgataaactcgcatgattcacttccaaatccaactccttaagtgcttccatgaacttagcaccaggatgattcctcttactacattgaatccttatcattgcatcccaaccaataatcttcacatcaacctccatctctatcaacacactcgattcttgattcaaacattttcgatcttttaccgaacttttcgcatttcccgcttctttattcatcacatcaatctgcttctgcaactcttctttatcagattcagccttttgcaacttagacttaagctcactgatatacgaaatagcatctcctaatagagaagctttatccatcttagacacattaggaaccacagctcttaaagaatagaatctctgattcaacttctctcttctctgtctctctgcctctacatgattcaaaggctcttctcttccattcgccggttttctccctcgtttcctcggtttcttctccggttcaaccacaactctgttactctcagcttctttagccactgaagcttcaagatcagagtgattcgagtcacatggaagaacagaggtaaaagaaagcatcccttcttcattattcgaaaccggtgatctcttcttattactactatcttcttcttgaccattctcaatcccattcttgaaattcaccatttcacaagatttcagaactttagggttagggttttcaacagagcttccattacaaagcttagaaattggttgagaatcagaattagaagttgagtcatttccaccattattcatcaccggagcagctacaagaccagagtcaacaccattaggttcactaatccacaaacctggatcattctctccttgatctggattcaaattaaacgcccaagaaccaaattcaccaccaccattgttaaaattgaaaaaggtgtcaactttatcaacaagatctgaactttgatgaataatctccgacgaaccaagctcaacgacaccattctctgtcgctacacacaccattgtttgtaacccataaatctgaccttgacgagctctctcacaacttgatccagctaaagcattagaaccagataaccaaatcgtgtctgaatttgagaaagcttgaccaggtaaaccagtacccttgacaaagctctgtgtcattgaaactaagaagaaccattcagtatctgtaacttcttcatctccagcttcatctcctcctcctacaccaccggagattaaagagttgagctctctaatcactctcttacgatgctcttgttcagctgcactagctggatttgatttcttctttctagacttctcttcttctcctttgtaataaccatctccccaacctaacaacactgtgttgttgttgttgttgtcttctccggcgaaaccgtgagatgattgccagaacacggcgtaagtccagttctcgtttgctccttcgattaaagcttggagacgttgctggagattatcttcgttgacttgaggaagaggaggaggaggaagtggaggaaaaagagaagaatgatcggagccgccgccgatgaaagcttccattaccgatgcatcgtcgtcggttgaccagagatttgttgtatccgtttttgattggttgagatggtaatcggttacttgaacattcgtcggagacat

SEQ ID NO: 896 - DNA, 1770 bp, Arabidopsis thaliana; identical to SEQ ID NO: 895
  G584 DNA sequence used for BLAST

SEQ ID NO: 897 - DNA, 2062 bp, Arabidopsis thaliana
  G586 cDNA Sequence
catgactagtcataacctttaaatcacttctgctttttttctgtttctcttttgatttattcaaagacaacaaagttttgtttttgacaaaaaatctgatctttgtttgttcgtttgtttgttacatggggatgaagaaacaatggcaaccggagaaaacagaacggtgccggacaatctaaagaaacagctcgcagtttcagttcgaaacattcaatggagttatggaatcttctggtctgtctctgcttctcaaccaggagtgttggagtggggagatggatattacaatggagacataaagacaaggaagacgattcaagcagcagaagtcaaaattgaccagttaggtcttgagagaagtgagcagcttagagagctttatgaatctctctccctcgctgaatcctcagcttccggtagctctcaggtcactagacgagcttccgccgccgctctctcaccggaggacctcaccgacaccgagtggtactacttagtatgcatgtctttcgtcttcaacatcggtgaaggaatccccggaggagcgttatccaatggagaaccaatatggctttgtaacgctgaaaccgccgatagcaaagtcttcactcgttctcttctagctaaaagtgcttcgcttcagacagtggtttgcttcccgtttcttggaggagtccttgagattggcacgaccgaacatattaaagaggacatgaacgtgatacaaagtgttaagacgttgttccttgaagctcctccatatactacaatatcgacaagatcagactatcaagaaatttttgatcccttaagtgacgataaatacactccggtgtttataaccgaagcttttccaacaacttctactagcgggtttgagtatgaacctgaggatcatgattcgttcatcaacgatggtggtgcgtctcaggtacaaagctggcagtttgtgggtgaagaaatcagtaactgcattcaccaatcgttaaattcaagcgattgcgtttcccaaacgtttgttggaacaaccgggagacttgcttgcgatccaaggaagagtaggattcaacggttaggtcagattcaagaacagagtaaccatgtaaatatggacgacgatgttcattaccaaggcgtgatatcgacgattttcaaaacaacgcatcagctaatactcggaccgcagtttcagaacttcgataagcggtctagcttcacaaggtggaagcgatcatcatctgtgaaaacattgggagagaaatcgcagaagatgataaagaagatactcttcgaggttcctttgatgaacaagaaagaagagttgttaccggacacaccagaggaaaccgggaaccatgccttgtccgagaagaaacgccgcgagaaattgaatgaacggtttatgacattgagatcaatcattccctcaattagtaagattgataaagtgtcgattcttgatgatacaattgagtatcttcaagatttacagaaacgggttcaagagttggaatcttgtagagaatctgctgatacagagacacggataacgatgatgaagaggaagaaaccggatgatgaggaggaaagagcatcagcgaattgtatgaacagcaaaaggaaggggagtgatgtgaatgtaggagaagatgaaccagctgatatcggttatgctggtctaacggataacttaaggatcagttcattaggtaacgaggtggttattgagcttagatgcgcttggagagaagggatattgcttgagataatggatgtgattagtgatctcaacttggattctcactcggttcagtcgtcaaccggagacggtttactctgcttaactgtcaattgcaagcataaagggacaaaaatagcaacaacaggaatgatccaagaggcacttcaaagggttgcatggatatgttaaggattcaaggtttagatttgacaaaattagctttttctctggtttggtttcccaattttcggtaatcagtgattctaaccgagtttttgtgattttggaaaaaaaaaaaaaaaaaaaaaaaaaaaaaaa

SEQ ID NO: 898 - protein, 596 aa, Arabidopsis thaliana
  G586 Amino Acid Sequence
MATGENRTVPDNLKKQLAVSVRNIQWSYGIFWSVSASQPGVLEWGDGYYNGDIKTRKTIQAAEVKIDQLGLERSEQLRELYESLSLAESSASGSSQVTRRASAAALSPEDLTDTEWYYLVCMSFVFNIGEGIPGGALSNGEPIWLCNAETADSKVFTRSLLAKSASLQTVVCFPFLGGVLEIGTTEHIKEDMNVIQSVKTLFLEAPPYTTISTRSDYQEIFDPLSDDKYTPVFITEAFPTTSTSGFEYEPEDHDSFINDGGASQVQSWQFVGEEISNCIHQSLNSSDCVSQTFVGTTGRLACDPRKSRIQRLGQIQEQSNHVNMDDDVHYQGVISTIFKTTHQLILGPQFQNFDKRSSFTRWKRSSSVKTLGEKSQKMIKKILFEVPLMNKKEELLPDTPEETGNHALSEKKRREKLNERFMTLRSIIPSISKIDKVSILDDTIEYLQDLQKRVQELESCRESADTETRITMMKRKKPDDEEERASANCMNSKRKGSDVNVGEDEPADIGYAGLTDNLRISSLGNEVVIELRCAWREGILLEIMDVISDLNLDSHSVQSSTGDGLLCLTVNCKHKGTKIATTGMIQEALQRVAWIC

SEQ ID NO: 899 - DNA, 2926 bp, Arabidopsis thaliana
  G586 DNA sequence used for BLAST
ttaacatatccatgcaaccctttgaagtgcctcttggatcattcctgttgttgctatttttgtccctttatgctgcaatcaacattaaacattacatatcacatttcggtttgctcatattccggttgagtaacataaatcaagcttggtttaatgactgtaccttgcaattgacagttaagcagagtaaaccgtctccggttgacgactgaaccgagtgagaatccaagttgagatcactaatcacatccattatctcaagcaatatcccttctctccaagcgcatctaagctcaataaccacctcgttacctaatgaactgatccttaagttatccgttagaccagcataaccgatatcagctggttcatcttctcctacattcacatcactccccttccttttgctgttcatacaattcgctgatgctctttcctcctcatcatccggtttcttcctcttcatcatcgttatccgtgtctctgtatcagcagattctctacaagattccaactcttgaacccgtttctgtaaatcttgaagatactcaattgtatcatcaagaatcgacactttatcaatctgtagaatcagcaagagactcaagcttagttccttcagagcattatatttaaacatgtcttcctattatcaagaaataaacataaaacgttactgaaacagatttgctagaatcggttaccttactaattgagggaatgattgatctcaatgtcataaaccgttcattcaatttctcgcggcgtttcttctcggacaaggcatggttcccggtttcctctggtgtgtccggtaacaactcttctttcttgttcatcaaaggaacctcgaagagtatcttctttatcatcttctgcgatttctctcccaatgttttcacagatgatgatcgcttccaccttgtgaagctagaccgcttatcgaagttctgaaactgcggtccgagtattagctgatgcgttgttttgaaaatcgtcgatatcacgccttggtaatgaacatcgtcgtccatatttacatggttactctgttcttgaatctgacctaaccgttgaatcctactcttccttggatcgcaagcaagtctcccggttgttccaacaaacgtttgggaaacgcaatcgcttgaatttaacgattggtgaatgcagttactgatttcttcacccacaaactgccagctttgtacctgagacgcaccaccatcgttgatgaacgaatcatgatcctcaggttcttgctcaaacccgctagtagaagttgttggaaaagcttcggttataaacaccggagtgtatttatcgtcacttaagggatcaaaaatttcttgatagtctgatcttgtcgatattgtagtatatggaggagcttcaaggaacaacgtcttaacactttgtatcacgttcatgtcctctttaatctaaaagaacaaaagataagttttgggtacttttaagaatgttttgatagtgttggaaaaaaaataggaaatataggcttacatgttcggtcgtgccaatctcaaggactcctccaagaaacgggaagcaaaccactgtctgaagcgaagcactctttaaagagcaaaacgccaaacgaaaaaaaaaaaaaaaaagagcgttttcagttatagcgttcttgaattctagcgttagcgtttccaattgcaaaaaacttactttagctagaagagaacgagtgaagactttgctatcggcggtttcagcgttacaaagccatattggttctccattggataacgctcctccggggattctacattagaaagacggaaataccctttatgttttgtatctcaaaatctttatcttaatgggaacaaaagttttctactactttctttgaatagcaaatgtataatgcaattatgcaaatgaagtaaaaacttatttccgttgtgctttcgcatttctatctatgtatgtcttctaagattaaaaagaggtatactttaaaaaaacctacaaacataaaaaaaattaagtaaatataaaggataattgcattgttaataattaaactcgtacatgtcggatttctgaataagctcacatggaagaagaaatgaaggagacaagctaataaagggtgttcttgtctttttttatgagacaaaataaaacatacccttatactttttttttagaattttggtatcgtttacattttcttataatgtctacgaataaaataatactataatttaaaaacgatattcttcataaaagaaatttttctgaaagataggtttttgtttttaaaaaaggtgaaatgaaaggattatgaggaagagacggaattacccttcaccgatgttgaagacgaaagacatgcatactaagtagtaccactcggtgtcggtgaggtcctccggtgagagagcggcggcggaagctcgtctagtgacctgagagctaccggaagctgaggattcagcgagggagagagattcataaagctctctaagctgctcacttctctcaagacctaactggtcaattttgacttctgctgcttgaatcgtcttccttgtctttatgtctccattgtaatatccatctccccactccaacactcttcgtttagagaaaacaaaaaagatagccaagaaaaattggattaatcgagaaaacataacaaaaatcgaaatcttgaagtaaggataaagttttatctgagttttggactaaagtcaagaatgtctcaaacaaaactttattttcaagaaaagttaatttgaaggataaagattacgagattgtaccctggttgagaagcagagacagaccagaagattccataactccattgaatgtttcgaactgaaactgcgagctgtttctttagattgtccggcaccgttctgttttctccggttgccat

SEQ ID NO: 900 - DNA, 1200 bp, Arabidopsis thaliana
  G589 cDNA Sequence
aaaaaaacagaagccatgaactcctcgtctcttctaactccttcatcatctccttctccacatcttcaatctcctgcaacattcgaccacgatgatttcctccaccacatcttctcctccactccttggccctcatccgttctcgacgacactcctccaccaacttccgattgtgcccccgtcactggattccaccaccacgacgccgattcaagaaaccagatcactatgattcctttgtcacataaccatcctaatgacgctctcttcaatggcttctccaccggatctctccctttccacctccctcaaggatcgggaggtcaaacgcaaacgcagtcgcaggcgacggcgtcagccaccaccggtggtgcaacggcgcaacctcagacaaagcctaaagtccgagctaggagaggtcaagccactgatcctcacagtatcgccgaacggttacggagagagaggatagcggaaagaatgaaatctcttcaagaacttgtccctaatggtaacaagacagacaaagcatcaatgctcgatgagattatcgattatgtcaagttcttacagctccaagtcaaggtactaagcatgagtagactgggcggtgctgcttctgcttcttctcaaatctctgaggatgccggtggatcccacgaaaacacctcctcctccggcgaggcgaagatgacggagcaccaagttgcaaagctaatggaagaggacatgggatcagccatgcaatatctacaaggcaaaggtctttgcctcatgcccatctcgttagccaccaccatctccaccgccacgtgtccttctcgtagccccttcgttaaagataccggcgttcctttgtctcctaacctatccactacaatagttgctaacggtaatggctcatcgttggtcaccgttaaagacgctccctccgtttccaagccgtgataacggccatttgtccatttcattttcccttttttgggtgggaaagagagaaaaaagtttagaagacaaagacaagtgggataggtggttttggtcaaagtttagaaagaataaggtcgtgttttcggatacgacaccgtatttgcgtacactttggttttctgtctttacctactacaaaccacccataagcacactcatgttatcatgtttttttttttttggtttataaagatataaaaaaaaaaaaaa

SEQ ID NO: 901 - protein, 310 aa, Arabidopsis thaliana
  G589 Amino Acid Sequence
MNSSSLLTPSSSPSPHLQSPATFDHDDFLHHIFSSTPWPSSVLDDTPPPTSDCAPVTGFHHHDADSRNQITMIPLSHNHPNDALFNGFSTGSLPFHLPQGSGGQTQTQSQATASATTGGATAQPQTKPKVRARRGQATDPHSIAERLRRERIAERMKSLQELVPNGNKTDKASMLDEIIDYVKFLQLQVKVLSMSRLGGAASASSQISEDAGGSHENTSSSGEAKMTEHQVAKLMEEDMGSAMQYLQGKGLCLMPISLATTISTATCPSRSPFVKDTGVPLSPNLSTTIVANGNGSSLVTVKDAPSVSKP

SEQ ID NO: 902 - DNA, 2118 bp, Arabidopsis thaliana
  G589 Genomic Sequence
atgaactcctcgtctcttctaactccttcatcatctccttctccacatcttcaatctcctgcaacattcgaccacgatgatttcctccaccacatcttctcctccactccttggccctcatccgttctcgacgacactcctccaccaacttccgattgtgcccccgtcactggattccaccaccacgacgccgattcaagaaaccagatcactatgattcctttgtcacataaccatcctaatgacgctctcttcaatggcttctccaccggatctctccctttccacctccctcaagtataactgataatccactttttctctctcattttgcaaattactacaaaagagaaaacattcattacatgttcttttgttaagtcttaatttaatgttttctgatatatattttagggatcgggaggtcaaacgcaaacgcagtcgcaggcgacggcgtcagccaccaccggtggtgcaacggcgcaacctcagacaaagcctaaagtccgagctaggagaggtcaagccactgatcctcacagtatcgccgaacgggttcgatttttttatttaacttttcctcattattcgcttttcagttaccgagaaaaacgtataaagttatttagatgattaaggtgattattgaaatattttgaaattatggaacagttacggagagagaggatagcggaaagaatgaaatctcttcaagaacttgtccctaatggtaacaaggtaaattttaattatcttcattagtctaaatttcgatcatcaaagttgatataattaaaagagtagattcaaataatccaatttgtattttacatttctttaatagtatatatctcaaaatgaataatgtgttaagtatatgagttacactgatgtattttagtcttggaccacaaattgctactagtttagtaggttatctagagatttggacttttatgcagtcaaatgattaaacactgattagctaattaattctaaaatttaattgataataatacttaataaacagatgcagaattgctaacaaggttttttttattgttaaaaataataattaacagacagacaaagcatcaatgctcgatgagattatcgattatgtcaagttcttacagctccaagtcaaggtgaatctctctctctctctctctcgaattattttataagatatgagaattttaaatttgtttttgttataagagtggaagcttctttacctttgagttgacattagaataagaaatcgaatatgggcctctgcaactaaaattccatatgctccctttcccttttatcttgtaaattatttatcttttgcgtttgttaaaacatagtgttagtgtatatctacctcttcttttgcttaattataatatttggcaaatttatgtatgcaggtactaagcatgagtagactgggcggtgctgcttctgcttcttctcaaatctctgaggtaataatttcaattccttctctcttaaaagggatgataggatgacgtgatcactatatagaatgagattttattttttaaactaattaaaaagagatgtaaattattgaaaaggttttagttagggaataatactaattaaaaagtagttttgttttcgactttctaaaaacaaatgaaaaagttttccaaaaaatagtaaaaaaaacaaaacaaggacagggcacgcgtgcctactttctctccaacaaataccaaaacctcccatttcaacatcatcatagctttagggttttgcttttcttgttttctttttaattttattgaacattttcaggatgccggtggatcccacgaaaacacctcctcctccggcgaggcgaagatgacggagcaccaagttgcaaagctaatggaagaggacatgggatcagccatgcaatatctacaaggcaaaggtctttgcctcatgcccatctcgttagccaccaccatctccaccgccacgtgtccttctcgtagccccttcgttaaagataccggcgttcctttgtctcctaacctatccactacaatagttgctaacggtaatggctcatcgttggtcaccgttaaagacgctccctccgtttccaagccgtga

SEQ ID NO: 903 - DNA, 2289 bp, Arabidopsis thaliana
  G589 DNA sequence used for BLAST
atggtaaatttggtaaacgtatttaacatgtcaaagtcaaacccttcaaatctcaaatattacaatctccatccctcttttaaacaccataaagccttaaacctcaaaagacatttcaacaacattcattttcattctcactccccaccaaaaaaaaaaaaaacagaagccatgaactcctcgtctcttctaactccttcatcatctccttctccacatcttcaatctcctgcaacattcgaccacgatgatttcctccaccacatcttctcctccactccttggccctcatccgttctcgacgacactcctccaccaacttccgattgtgcccccgtcactggattccaccaccacgacgccgattcaagaaaccagatcactatgattcctttgtcacataaccatcctaatgacgctctcttcaatggcttctccaccggatctctccctttccacctccctcaagtataactgataatccactttttctctctcattttgcaaattactacaaaagagaaaacattcattacatgttcttttgttaagtcttaatttaatgttttctgatatatattttagggatcgggaggtcaaacgcaaacgcagtcgcaggcgacggcgtcagccaccaccggtggtgcaacggcgcaacctcagacaaagcctaaagtccgagctaggagaggtcaagccactgatcctcacagtatcgccgaacgggttcgatttttttatttaacttttcctcattattcgcttttcagttaccgagaaaaacgtataaagttatttagatgattaaggtgattattgaaatattttgaaattatggaacagttacggagagagaggatagcggaaagaatgaaatctcttcaagaacttgtccctaatggtaacaaggtaaattttaattatcttcattagtctaaatttcgatcatcaaagttgatataattaaaagagtagattcaaataatccaatttgtattttacatttctttaatagtatatatctcaaaatgaataatgtgttaagtatatgagttacactgatgtattttagtcttggaccacaaattgctactagtttagtaggttatctagagatttggacttttatgcagtcaaatgattaaacactgattagctaattaattctaaaatttaattgataataatacttaataaacagatgcagaattgctaacaaggttttttttattgttaaaaataataattaacagacagacaaagcatcaatgctcgatgagattatcgattatgtcaagttcttacagctccaagtcaaggtgaatctctctctctctctctctcgaattattttataagatatgagaattttaaatttgtttttgttataagagtggaagcttctttacctttgagttgacattagaataagaaatcgaatatgggcctctgcaactaaaattccatatgctccctttcccttttatcttgtaaattatttatcttttgcgtttgttaaaacatagtgttagtgtatatctacctcttcttttgcttaattataatatttggcaaatttatgtatgcaggtactaagcatgagtagactgggcggtgctgcttctgcttcttctcaaatctctgaggtaataatttcaattccttctctcttaaaagggatgataggatgacgtgatcactatatagaatgagattttattttttaaactaattaaaaagagatgtaaattattgaaaaggttttagttagggaataatactaattaaaaagtagttttgttttcgactttctaaaaacaaatgaaaaagttttccaaaaaatagtaaaaaaaacaaaacaaggacagggcacgcgtgcctactttctctccaacaaataccaaaacctcccatttcaacatcatcatagctttagggttttgcttttcttgttttctttttaattttattgaacattttcaggatgccggtggatcccacgaaaacacctcctcctccggcgaggcgaagatgacggagcaccaagttgcaaagctaatggaagaggacatgggatcagccatgcaatatctacaaggcaaaggtctttgcctcatgcccatctcgttagccaccaccatctccaccgccacgtgtccttctcgtagccccttcgttaaagataccggcgttcctttgtctcctaacctatccactacaatagttgctaacggtaatggctcatcgttggtcaccgttaaagacgctccctccgtttccaagccgtga

SEQ ID NO: 904 - DNA, 1292 bp, Arabidopsis thaliana
  G590 cDNA Sequence
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 905 - protein, 373 aa, Arabidopsis thaliana
  G590 Amino Acid Sequence
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 906 - DNA, 1779 bp, Arabidopsis thaliana
  G590 Genomic Sequence
atgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggttttttctcaatctctgttttttatcttttgcatgttttaaaagttgattctttgtctctttcccgagaaaatgtttctacagagatttctctttaacggatctgtactttattttcccccttaaaatccgcaatttttttggttgtgattttgagtgaagttttgtcatttgtgagtgtaataatgaatgcacaccgagtgtttgataatttgcttcaatgaaaatacaggaaggaggagaagctgtagttgatgaagctccctcttccaagtcaggtccttcttctcgtagttcatctaaaagatgcagagctgctgaagttcataatctctctgagaaggtttggtttagagtctctcccaaaagtagaaactttcttatttgagatttatgtttatctttcttgtaacagaggaggagaagtagaattaatgaaaaaatgaaagctttacaaagtctcatccctaattcaaataaggtaatgatactatatatagagagacatctacatgaatcattctattttctgtagattctttttgtgtctgattattgcaatgtgtttattggggaagacggataaggcttcaatgcttgatgaagccattgagtatctgaaacagcttcagctccaagttcaggtcactaaagataccttatgtttatcattataaccaaaatcctaaaaccagtctatattctgacataagtctttttttgttctgatatttgcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggtgcgtagttgaattacacatttttcattctataaccataaagctagtttgcttactaatttttttttgttacttaaggagatgagtcgggaaggtgggttaactcatccaaggttgaacattggtcattccaacgcaaacataaccggtaaagtcttgttgttttggaatcctaaggaagttttaggacatttacaatgttaataacgttacgatatttggggatttgcaggggaacaagctctgtttgatggacaacctgacctaaaagatcgaattacttga

SEQ ID NO: 907 - DNA, 1506 bp, Arabidopsis thaliana
  G590 DNA sequence used for BLAST
tcaactacgcaccacgggtgaagtaaggagagggaaaggtccaaagtgactgcgaatagaaggttccaaagcgtatgaagaagccacagtattgatcatttccggtgcattagaagtcgaagcaaactgattggtatgattaagcagaggatcattggttgcttcagggggtcgaatctgagagagttgcaatgggtgtaatgtagttccaggtaaacacaaaggatgcaagtttattccatttctcatagtcaacatctgcaaatatcagaacaaaaaaagacttatgtcagaatatagactggttttaggattttggttataatgataaacataaggtatctttagtgacctgaacttggagctgaagctgtttcagatactcaatggcttcatcaagcattgaagccttatccgtcttccccaataaacacattgcaataatcagacacaaaaagaatctacagaaaatagaatgattcatgtagatgtctctctatatatagtatcattaccttatttgaattagggatgagactttgtaaagctttcattttttcattaattctacttctcctcctctgttacaagaaagataaacataaatctcaaataagaaagtttctacttttgggagagactctaaaccaaaccttctcagagagattatgaacttcagcagctctgcatcttttagatgaactacgagaagaaggacctgacttggaagagggagcttcatcaactacagcttctcctccttcctgtattttcattgaagcaaattatcaaacactcggtgtgcattcattattacactcacaaatgacaaaacttcactcaaaatcacaaccaaaaaaattgcggattttaagggggaaaataaagtacagatccgttaaagagaaatctctgtagaaacattttctcgggaaagagacaaagaatcaacttttaaaacatgcaaaagataaaaaacagagattgagaaaaaacctcgctttcacagtcatactcatctgtctcgttgccactagctccaacggaagaagacgatactcgagtcccagagctatttccttgaacgttgttattattaccaccaccggagaaaccaaaacacgcggcggctgagcctgatcctccgccgattaaaacctcagagaaatctccgacacgtttcgacataagcacagaatctgacggtggatgatgagaaacgagacttctcgagttatctgcatgtgggtcaccgctcccgtgcacaccaatcaaagacgccgtcgttgtagtcgtcgccggggagtagtaagaaggtaaaggagaagaacggtcgaaaatatgccggagaaactgagagatttcgtcggaagaagacggaggatgatgaagatgatgattgatacgagtatcgtaaaccgaggaagaagaagaagatgaaatcaatttcttatctcccatcactctctgcttcttctcttctctttcttctctctgtgatatcat

SEQ ID NO: 908 - DNA, 1240 bp, Arabidopsis thaliana; identical to SEQ ID NO: 10
  G591 cDNA Sequence

SEQ ID NO: 909 - protein, 310 aa, Arabidopsis thaliana
  G591 Amino Acid Sequence
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 910 - DNA, 2320 bp, Arabidopsis thaliana
  G591 Genomic Sequence
atggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgtaagttctgttcttgctttggtgtttgattattagaaatgggaagaaatcgaatttgagggttttgaagagaacatttttggtaacttttgttttagtttttgatttgtggtaagtaactttaacaaagttgatgatttgcgttatgtgctttattttggctcagacttgttgaatctaatcgattttggtttgtttagtaaactaaggttagctcttgttactctatgagcaacttctcactagttcatgtagctgcgtggcttatcttgccttctaagttggtcaaatgagtaatcttaagggtctaacttaaattattctcttacaactaatggagtcaaatccttgtgcaaatggtttattttcgtttggtcttatttcttctgtgtgttgtctggaaggttttccacgggcagcctatgcaacagccacctccatcggccccacatcagcctacttcaatccgtcccagggttcgagctaggcgtggtcaggctactgatccacatagcatcgctgagcgggtatatttcagattctcttttgtatttccctgtgatatactatgttggtggcgagttggttgtagttgaaaatatgtttcggatataaaaaaatgttaacattgtgtaatgatctcttgattttatggagggattacctaaaagtttgttttactttaccacagctacgtagagaaagaatagcagaacggatcagggcgctgcaggaacttgtacctactgtgaacaaggtctgtacctttcaccctaaccctcacctgtatataatttctctagaaagtttgacactttctgtttctcccgtcttcgtgtgcagaccgatagagctgctatgatcgatgagattgtcgattatgtaaagtttctcaggctccaagtcaaggtatattcttctctcttctgcagttttaaactcgaactctctttcttgtgaattatcttattactccctatgcaatatgtttaatctgtttgttcataagattagagatctaaagatcatgtctttcaaattctctggatggatttttggtgttaattctggtcccaccattacctacccttcaaccaaatttcaatctgattagatcagttatttaatgtgggaaagaataaacaagtccaaaatgcttttgttttctttggcatttagtctcttttcactttttgttttgtcatagggagcctaatcacagtttatgattataataccatattcaacaataattacaatcatcatgttcacattataatatagtaatctggtagatcatcaaatgcttcttatatcaaaatgcagtcggttacttaaagctctcgcaagcgaaaaaaggaagtctctttactttataagataatggagacactaaagaaacagaatgcaatgatggatttctgataagataatacatcttttgttttaaaaatagaaaatgtgtttcttgtgaaatcttccatgctcatctaaaagtaaaagctttttttatatatataattttcatggggtgaagcttatcactttcaatgatatctgtttctctttgtcaactttggtaggttttgagcatgagccgacttggtggagccggtgcggttgctccacttgttactgatatgcctctttcatcatcagttgaggtaaaaactttttaagaacaaaaagtaaaaactttagtaatggggttttgattcagattttgcttaaaatgtcaataggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctga

SEQ ID NO: 911 - DNA, 2339 bp, Arabidopsis thaliana
  G591 DNA sequence used for BLAST
atggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgtaagttctgttcttgctttggtgtttgattattagaaatgggaagaaatcgaatttgagggttttgaagagaacatttttggtaacttttgttttagtttttgatttgtggtaagtaactttaacaaagttgatgatttgcgttatgtgctttattttggctcagacttgttgaatctaatcgattttggtttgtttagtaaactaaggttagctcttgttactctatgagcaacttctcactagttcatgtagctgcgtggcttatcttgccttctaagttggtcaaatgagtaatcttaagggtctaacttaaattattctcttacaactaatggagtcaaatccttgtgcaaatggtttattttcgtttggtcttatttcttctgtgtgttgtctggaaggttttccacgggcagcctatgcaacagccacctccatcggccccacatcagcctacttcaatccgtcccagggttcgagctaggcgtggtcaggctactgatccacatagcatcgctgagcgggtatatttcagattctcttttgtatttccctgtgatatactatgttggtggcgagttggttgtagttgaaaatatgtttcggatataaaaaaatgttaacattgtgtaatgatctcttgattttatggagggattacctaaaagtttgttttactttaccacagctacgtagagaaagaatagcagaacggatcagggcgctgcaggaacttgtacctactgtgaacaaggtctgtacctttcaccctaaccctcacctgtatataatttctctagaaagtttgacactttctgtttctcccgtcttcgtgtgcagaccgatagagctgctatgatcgatgagattgtcgattatgtaaagtttctcaggctccaagtcaaggtatattcttctctcttctgcagttttaaactcgaactctctttcttgtgaattatcttattactccctatgcaatatgtttaatctgtttgttcataagattagagatctaaagatcatgtctttcaaattctctggatggatttttggtgttaattctggtcccaccattacctacccttcaaccaaatttcaatctgattagatcagttatttaatgtgggaaagaataaacaagtccaaaatgcttttgttttctttggcatttagtctcttttcactttttgttttgtcatagggagcctaatcacagtttatgattataataccatattcaacaataattacaatcatcatgttcacattataatatagtaatctggtagatcatcaaatgcttcttatatcaaaatgcagtcggttacttaaagctctcgcaagcgaaaaaaggaagtctctttactttataagataatggagacactaaagaaacagaatgcaatgatggatttctgataagataatacatcttttgttttaaaaatagaaaatgtgtttcttgtgaaatcttccatgctcatctaaaagtaaaagctttttttatatatataattttcatggggtgaagcttatcactttcaatgatatctgtttctctttgtcaactttggtaggttttgagcatgagccgacttggtggagccggtgcggttgctccacttgttactgatatgcctctttcatcatcagttgaggtaaaaactttttaagaacaaaaagtaaaaactttagtaatggggttttgattcagattttgcttaaaatgtcaataggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtag

SEQ ID NO: 912 - DNA, 1413 bp, Arabidopsis thaliana; identical to SEQ ID NO: 101
  G592 cDNA Sequence

SEQ ID NO: 913 - protein, 359 aa, Arabidopsis thaliana
  G592 Amino Acid Sequence
MDSNNHLYDPNPTGSGLLRFRSAPSSVLAAFVDDDKIGFDSDRLLSRFVTSNGVNGDLGSPKFEDKSPVSLTNTSVSYAATLPPPPQLEPSSFLGLPPHYPRQSKGIMNSVGLDQFLGINNHHTKPVESNLLRQSSSPAGMFTNLSDQNGYGSMRNLMNYEEDEESPSNSNGLRRHCSLSSRPPSSLGMLSQIPEIAPETNFPYSHWNDPSSFIDNLSSLKREAEDDGKLFLGAQNGESGNRMQLLSHHLSLPKSSSTASDMVSVDKYLQLQDSVPCKIRAKRGCATHPRSIAERVRRTRISERMRKLQELVPNMDKQTNTSDMLDLAVDYIKDLQRQYKILNDNRANCKCMNKEKKSI

SEQ ID NO: 914 - DNA, 1736 bp, Arabidopsis thaliana
  G592 Genomic Sequence
ctatattgacttcttctccttgttcatacacttacagttagctctgttgtcgtttaaaatctgtgtaaaaccaacagaagactaaatcaattcaacagaagactaaacaggcccctttgttttttttccacaatgatcaggaactttaccttatactgtctttgtaaatctttgatgtaatccacagctaaatccaacatatccgaagtgttggtttgctgttaaaacataaagaaaacaacatcatttaacaatttgtttatgatcaaaagtcattacaaggaagttcctgaaaactgtaccttgtccatgttaggaacaagctcttgtaacttcctcattcgctcgcttatccgcgttcttcttacctgacacaattgacaagatttcttaggaaaggctttctgaaaacaaactagattctgcttcaaatggacttccattgatatatgtaaagatggccttaactaggtgaagttacccgttcagcgatgcttcgaggatgtgtagcgcaaccacgtttggctctgattttacaaggaacagaatcttgtagctgaagatacttatccactgaaaccatgtccgaggctgtcgatgatgactttggtaggctcaaatgatgcgacagtaactgcatacgattcccggactctccgttctgtagaaacccatcaaaaacatcattagaaaccactccaagaaatcaactccactttcagctactgatcaataaccaaaacaaaccggttagataaccgagttacctgagctccgagaaacaattttccatcgtcctcggcttctcttttaagtgaggataagttatcaataaagctggatggatcattccaatggctatatggaaaattagtttcgggtgcgatttcaggtatttgagaaagcattccaagtgaagaaggtggccttgaagagagactgcaatggcgtcttaatccattggaattagatggactctcttcatcttcttcgtaattcatcaaattcctcattgaaccataacctgcaaatttgtaagtatatagtaaacacttattagatttgttgagtccaaagtgctttaactctatggttgacaaaatcaaatcagatcttgtcttaaaattattctcaaggaacgtaaaacattcaaaaatcttgaagcaagtgttaaaacattcaaaaaagttgaatcaagaagtaccaaaaacacttctgttataaatgaaaaaaatatttcagactaaaaaaagggggaaaaactttgtagcagagagcaaaacggtaccgttttggtcagagagattagtaaacattccggctggagagctgctttgacggagaagattagattcaactggtttggtgtgatgattattgataccgagaaactgatccaaaccaaccgagttcattatccctttactctgcctcgggtaatgcggcggcaaacccagaaaactcgacggctcaagctgcggcggtggcggcagagtggcggcgtatgaaacagaggtgttcgttaacgaaaccggagacttatcctcgaatttaggtgaacccagatctccgttaacgccattagaggtcacgaatcttgaaagcaacctatcggagtcgaaaccaatcttgtcgtcgtcaacaaaagcggcgagaacagagctcggagctgatctaaaacgaagaagacccgacccggtgggattcgggtcgtagagatgattatttgaatccat

SEQ ID NO: 915 - DNA, 1736 bp, Arabidopsis thaliana; identical to SEQ ID NO: 914
  G592 DNA sequence used for BLAST

SEQ ID NO: 916 - DNA, 1157 bp, Arabidopsis thaliana
  G593 cDNA Sequence
cgtcctaatgtatccttctctcgacgatgatttcgtctctgatttgttttgcttcgatcaaagggggaaaggttgtgtcttttgatgataatttgacgaaccctaatgtatctgaaagctgttaaattgaataggagaagaagtagctttatggatgttgttgtttatatttactcctattgatggatgtgaatctttttggtcatgatgactcttgtagcaatggagcagaacttgatgattacacacagtttggtgtaaatttgcagactgatcaagaggatacctttccagattttgtgtcatatggtgtgaatttgcagcaggagccagatgaagtctttagtattggagcttctcaattggatttgtcctcgtataatggagttttgtcgctagagccagaacaggtggggcaacaagattgtgaagttgtgcaggaagaagaagtagagatcaattctggttcatctggtggagctgttaaggaagaacaggaacatttagatgacgattgctccagaaagcgggcaaggactggatcgtgtagcagaggaggaggaactaaagcgtgtcgtgaaaggttgaggagggagaagctaaatgagaggtttatggatttgagctcggttttggagcctgggaggactcctaagactgataaaccggctatactcgatgatgcaatccgtatattgaatcaacttagagatgaagctcttaagcttgaagaaactaaccagaagcttttagaggagatcaagagtctcaaggcggagaagaacgagctgagggaggaaaagctggtgttgaaggcggataaagagaagacagaacaacagttaaagtctatgacggctccatcttcagggttcatacctcatattccagctgcatttaaccacaacaaaatggctgtttatccaagttacggttacatgccaatgtggcattatatgcctcaatccgttcgtgacacatctcgtgatcaagaactcaggcctcctgctgcttaaactctcaattgtttttttttggtacccatagggaactcatagagatttctgaatcacttggtttaggattcttccgtttggcaagtgtaaaagctttactcttgatcttgggttgtatttttcttataaaataaatataac

SEQ ID NO: 917 - protein, 277 aa, Arabidopsis thaliana
  G593 Amino Acid Sequence
MDVNLFGHDDSCSNGAELDDYTQFGVNLQTDQEDTFPDFVSYGVNLQQEPDEVFSIGASQLDLSSYNGVLSLEPEQVGQQDCEVVQEEEVEINSGSSGGAVKEEQEHLDDDCSRKRARTGSCSRGGGTKACRERLRREKLNERFMDLSSVLEPGRTPKTDKPAILDDAIRILNQLRDEALKLEETNQKLLEEIKSLKAEKNELREEKLVLKADKEKTEQQLKSMTAPSSGFIPHIPAAFNHNKMAVYPSYGYMPMWHYMPQSVRDTSRDQELRPPAA

SEQ ID NO: 918 - DNA, 1086 bp, Arabidopsis thaliana
  G593 Genomic Sequence
atggatgtgaatctttttggtcatgatgactcttgtagcaatggagcagaacttgatgattacacacagtttggtgtaaatttgcagactgatcaagaggatacctttccagattttgtgtcatatggtgtgaatttgcagcaggagccagatgaagtctttagtattggagcttctcaattggatttgtcctcgtataatggagttttgtcgctagagccagaacaggtggggcaacaagattgtgaagttgtgcaggaagaagaagtagagatcaattctggttcatctggtggagctgttaaggaagaacaggaacatttagatgacgattgctccagaaagcggtgagttttgaaaaaatataaactttttgtgatttggtggtagttggttgtgtttttaattgaatctgtgatggttgttgatagggcaaggactggatcgtgtagcagaggaggaggaactaaagcgtgtcgtgaaaggttgaggagggagaagctaaatgagaggtatgtttagagcttagtctatgtttttgttttgtgaagtgagttgtctcaaggggaaaaaaattgttgttgttctgttaggtttatggatttgagctcggttttggagcctgggaggactcctaagactgataaaccggctatactcgatgatgcaatccgtatattgaatcaacttagagatgaagctcttaagcttgaagaaactaaccagaagcttttagaggagatcaagagtctcaaggttggttgttcattcactttcacctaaaccaagaatcttgttcaatgggatgtgaacagatttctaagtttgtatgtttctttataggcggagaagaacgagctgagggaggaaaagctggtgttgaaggcggataaagagaagacagaacaacagttaaagtctatgacggctccatcttcagggttcatacctcatattccagctgcatttaaccacaacaaaatggctgtttatccaagttacggttacatgccaatgtggcattatatgcctcaatccgttcgtgacacatctcgtgatcaagaactcaggcctcctgctgcttaa

SEQ ID NO: 919 - DNA, 1086 bp, Arabidopsis thaliana; identical to SEQ ID NO: 918
  G593 DNA sequence used for BLAST

SEQ ID NO: 920 - DNA, 868 bp, Arabidopsis thaliana
  G595 cDNA Sequence
cggacgcgtgggcggacgcgtggggtttgagcgcatcgcaaactcgaaggcgcgactgtgagagagaagaatggcgtcgtcatcatcgagaggagagatggagaagatgggaatcgatcagctaaaagctttgaaggagcaagcagatctggaagtgaatcttcttcaagatagtctcaacaacatccgtacagctaccgttcgtctcgatgccgccgccgcagctctcaacgatctctctcttcgacctcaaggtaagaagatgcttgtaccactgactgcttctctatacgtgcctgggacacttgatgaagctgataaggttttagttgatattggcactggttacttcattgagaaaacaatggatgatggaaaagattattgtcagaggaagatcaacttgctcaaatccaactttgatcaactttttgaggtcgcagcgaaaaagaaaagcgtggcagatgaagctggaatggtcttgcaggccaaagttaaacagttaacagctgcaaccacgtcgtgaaaattattccttctctagtgctttttgctattgagactattttgagattgcaaatgattttgtctgatcagttatgttttgactcttttgatctcaatcggcttgtgtttagtgtgctagaagaatttgtgctgtaattttaagtaatcagtagtgactatgagaaagaaaagacgtgttaactagttatttctcataaaacgtgagaaaagagacaaaagcgatgatgttattggaggcaaaaacgatgatgttattgttgggggtagaaagagacaactgaatcaatgaactttaaatacaacttgttttgttgttttaagaaaagggatctttccgcaa

SEQ ID NO: 921 - protein, 151 aa, Arabidopsis thaliana
  G595 Amino Acid Sequence
MASSSSRGEMEKMGIDQLKALKEQADLEVNLLQDSLNNIRTATVRLDAAAAALNDLSLRPQGKKMLVPLTASLYVPGTLDEADKVLVDIGTGYFIEKTMDDGKDYCQRKINLLKSNFDQLFEVAAKKKSVADEAGMVLQAKVKQLTAATTS

SEQ ID NO: 922 - DNA, 1345 bp, Arabidopsis thaliana
  G595 Genomic Sequence
atggcgtcgtcatcatcgagaggagagatggagaagatgggaatcgatcagctaaaagctttgaaggagcaagcagatctggaagtgaatcttcttcaagatagtctcaacaacatccgtacagctaccgttcgtctcgatgccgccgccgcagctctcaacgatctctctcttcgacctcaaggttttgtttatttcacctctccttcttcaatttcagcgatggatgattataaaacaatttgaaaattgtaggtaagaagatgcttgtaccactgactgcttctctatacgtgcctgggacacttgatgaagctgataaggttttagttgatattggcactggttacttcattgaggtaatagaaaacttcaataagtaattggattattatgactttgttcttgtgtagctcaagtgttttgctgcatttttatgtagaaaacaatggatgatggaaaagattattgtcagaggaagatcaacttgctcaaatccaactttgatcaactttttgaggtaatatgtattcgcaattaggatcatttcactatcttagcaacttttaaaggcctgatttggtttttagatagattctgagtgaaagggaatatgtattcgaatgccagtgagtatgccttagaactgtacttttaggtattgaaggcctacacttttccttcatacggcttattgaatatgccttagaactgtccttttactgaaggataacacatttctcataacatttacgaaaattgtgaatgagcaaagtggataagattttttgaattgaatggagtctgattctgttactaggggtgaatctttgtggacttctttcactgacttgatccattgtataaaaatgtttgaggccttaaagttttatggaatgcaagtacgtagtcagaaagccctttggttgatcctttcctgcattgtcaaacactccctagtccctagagccatacatgatacactaaggatcctttcctgcattgtcaaacactccctagtccctagagccatacatgatacactaagtagaggtctgagtattgttttcgtataaagcaaaattcaatgctatgatctcacgtttcctttccatttgcttcaatagttattgaaatcaagtgcatcattgccaaattgtttcaatactcttttattttgaaaaccctattgttactgctgtttatctcacctgagattttagttataaacttcaaaaatgttcattcaatgcaggtcgcagcgaaaaagaaaagcgtggcagatgaagctggaatggtcttgcaggccaaagttaaacagttaacagctgcaaccacgtcgtga

SEQ ID NO: 923 - DNA, 538 bp, Arabidopsis thaliana
  G595 DNA sequence used for BLAST
atggcgtcgtcatcatcgagaggagagatggagaagatgggaatcgatcagctaaaagctttgaaggagcaagcagatctggaagtgaatcttcttcaagatagtctcaacaacatccgtacagctaccgttcgtctcgatgccgccgccgcagctctcaacgatctctctcttcgacctcaaggttttgtttatttcacctctccttcttcaatttcagcgatggatgattataaaacaatttgaaaattgtaggtaagaagatgcttgtaccactgactgcttctctatacgtgcctgggacacttgatgaagctgataaggttttagttgatattggcactggttacttcattgaggtaatagaaaacttcaataagtaattggattattatgactttgttcttgtgtagctcaagtgttttgctgcatttttatgtagaaaacaatggatgatggaaaagattattgtcagaggaagatcaacttgctcaaatccaactttgatcaactttttgaggtaatatgtattcgcaat

SEQ ID NO: 924 - DNA, 1226 bp, Arabidopsis thaliana; identical to SEQ ID NO: 78
  G598 cDNA Sequence

SEQ ID NO: 925 - protein, 263 aa, Arabidopsis thaliana
  G598 Amino Acid Sequence
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIEYNVGSFNNRLNEEARGEKSKSDGENAKQCGESAEESGGEKSDGRGKERDRGCKSS

SEQ ID NO: 926 - DNA, 1334 bp, Arabidopsis thaliana
  G598 Genomic Sequence
tcaactacttttgcaacctctgtccctctctttgcctctgccgtcgctcttctctcctccgctttcctctgcgctttcgccacattgttttgcgttttctccatcgcttttgcttttctctcctctagcttcctctgcatgcatcgatcccaaattgttagcttaacttatacatacatatctctatgtatacattatgaacccgtcatgaatgatcaccatttagacgattgttgaatgaacctacattatactgaatatttttcactatattaattattatgaatcctggaaaggtaattcaacaatgtttgtataattggaaatgacgatgccatgcacgatggtaaataaatactactatttaaaagactaaaaacattaattagaagctagaaatgtgagagaactaaccatctcacacctaattacagacaaattatgccaccacaccattcctactatagtttacaatttttcagatgagaagattacgtttgacattccaaatggcgataaacccaaaaaaaatgtttatactgccaagtgccaactaagtccacttaattatactatcacatggtctaattctatattaaccagcttactaaccccaatacttaatcccatagctcaaatccaaatctgacgcatgttactaaattaatcatcgtacgtgggaccggaatttaattataaaaaaaaattacctcaattttcttcatccaagagttggccttgttaacttgttcattaaaccaaccgttaataacggcgtcttccctcttaaacctgttattaatcttagccagttttgccgtctgccacgccgttatcttcgcttccacctcttccctcttaactctttgcaccgtcgacccaacccgactctgacccggcccattatcacttccaggatccaaacccgaaccaggatactgatccggcacgattgctaaaggattcgtttcctcttcatgatccgtgtcctcgtggattctcatcaactcgtcttgtctctcatcttcacgctgcgtgacgtcacgagtcattagttcgttgttctccatggaggatccggcgatgactagagcgttgaactctctgcttatagttgtgaagttctctccttcgctcatcgtcgtcgctgaccttggaggagaaaaatagcctcggaaagcaggcggtggaggtagcgtcgccgtcatcgtccgggaattatcctccggcgctggagttagcgcgtggacttctctaaccacagtctctggcgtctcatcgcgatcattacttgtggcgtccggtgacctttcttgatggtaaagagtcagcat

SEQ ID NO: 927 - DNA, 1401 bp, Arabidopsis thaliana
  G598 DNA sequence used for BLAST
atgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgaggtaatttttttttataattaaattccggtcccacgtacgatgattaatttagtaacatgcgtcagatttggatttgagctatgggattaagtattggggttagtaagctggttaatatagaattagaccatgtgatagtataattaagtggacttagttggcacttggcagtataaacattttttttgggtttatcgccatttggaatgtcaaacgtaatcttctcatctgaaaaattgtaaactatagtaggaatggtgtggtggcataatttgtctgtaattaggtgtgagatggttagttctctcacatttctagcttctaattaatgtttttagtcttttaaatagtagtatttatttaccatcgtgcatggcatcgtcatttccaattatacaaacattgttgaattacctttccaggattcataataattaatatagtgaaaaatattcagtataatgtaggttcattcaacaatcgtctaaatggtgatcattcatgacgggttcataatgtatacatagagatatgtatgtataagttaagctaacaatttgggatcgatgcatgcagaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaa

SEQ ID NO: 928 - DNA, 1857 bp, Arabidopsis thaliana
  G599 cDNA Sequence
tcgacagaacagcttcgttgtcacttgtcattctataaatcgcatccccattgacaacctttcacttccatcaaaactctctctctatatctctctctctatatatctctctctatatctctctctctcttcactctctctttctttcaaaatggaaaaactcatggttccgacatggagacccgacccggtttaccgtccaccggaaacaccactcgaaccgatggagtttttagctcgttcatggagcgtctctgctctcgaagtctccaaggctctaacaccacccaaccctcagattctcctctccaaaaccgaagaagaagaagaagaagaacccatctcctctgtcgtagacggcgacggcgacacggaagacaccggacttgtcaccggaaacccattctccttcgcttgttcagaaacttctcaaatggtcatggatcgtatcttgtctcactctcaagaagtatcaccaagaacatctggtcggctatctcacagtagtggtccacttaatggttctttgaccgacagtcctcctgtgtctcctcccgaatccgacgacattaagcaattttgcagagcgaacaaaaattcattgaacagtgtaaattctcagttccgttcaacggcggcaactccgggacctataaccgctacagctacacagtccaagacggtgggacggtggcttaaggaccggagagagaaaaagaaagaggagactcgggctcataacgctcagattcacgctgctgtctctgtcgccggcgttgctgcagctgttgctgctattgcagcagccaccgctgcgtcttctagctgtggtaaggatgagcagatggctaaaactgacatggccgttgcttctgctgcgacccttgtggctgctcagtgtgtggaagctgctgaagttatgggagctgagagagagtatttggcttctgttgttagctccgccgtcaatgttcgttctgccggagatattatgactctcaccgccggagcagctacagctttaagaggagtgcaaacattgaaggcaagggcaatgaaggaagtgtggaacatagcatcagtgataccaatggataaaggactcacttctacaggaggaagcagcaataatgttaatggtagcaatggaagctcaagcagtagtcacagtggtgaacttgtacaacaggagaatttcttgggaacttgtagtagagaatggctcgctagaggttgtgaactcctcaaacgcactcgcaaaggtgatctccactggaagatagtatctgtttacatcaacaaaatgaatcaggttatgttgaagatgaagagcaggcatgttggaggaaccttcaccaagaagaaaaagaacattgtgcttgatgtgatcaagaatgtcccggcctggcctggacgacatttgctagagggaggagatgatctaagatacttcggtttgaagacggttatgcgaggtgatgttgaattcgaggtcaagagccaaagggaatatgaaatgtggacacaaggtgtctcaaggcttcttgttcttgctgctgagaggaagtttaggatgtgaataaacgttcaatggctgcttggtttaagtgtgagtttttttttaacttatgtggtcaaatttcattagtaggggttcttttaaggtaatggttttttgggttgggtataggataaaatggacctaccagtcaaggtgaggaagcatttgggtaaacaaaacttagtgggggtgatctgtaatatctatgttcttagtttttttttggttgttggtggtctttttgtataaaaaaacaaagttgaagtaatagatatatagtatgttttaattttaaa

SEQ ID NO: 929 - protein, 475 aa, Arabidopsis thaliana
  G599 Amino Acid Sequence
MEKLMVPTWRPDPVYRPPETPLEPMEFLARSWSVSALEVSKALTPPNPQILLSKTEEEEEEEPISSVVDGDGDTEDTGLVTGNPFSFACSETSQMVMDRILSHSQEVSPRTSGRLSHSSGPLNGSLTDSPPVSPPESDDIKQFCRANKNSLNSVNSQFRSTAATPGPITATATQSKTVGRWLKDRREKKKEETRAHNAQIHAAVSVAGVAAAVAAIAAATAASSSCGKDEQMAKTDMAVASAATLVAAQCVEAAEVMGAEREYLASVVSSAVNVRSAGDIMTLTAGAATALRGVQTLKARAMKEVWNIASVIPMDKGLTSTGGSSNNVNGSNGSSSSSHSGELVQQENFLGTCSREWLARGCELLKRTRKGDLHWKIVSVYINKMNQVMLKMKSRHVGGTFTKKKKNIVLDVIKNVPAWPGRHLLEGGDDLRYFGLKTVMRGDVEFEVKSQREYEMWTQGVSRLLVLAAERKFRM

SEQ ID NO: 930 - DNA, 3380 bp, Arabidopsis thaliana
  G599 Genomic Sequence
tcacatcctaaacttcctctcagcagcaagaacaagaagccttgagacaccttgtgtccacatttcatattccctttggctcttgacctcgaattcaacatcacctcgcataaccgtcttcaaaccgaagtatcttagatcatctcctccctctagcaaatgtcgtccaggccaggccgggacattcttgatcacatcaagcacaatgtctgtaacaaaattggaaagatagtaaaataattaatagaagagtcttcttcaagttcacattcaaaagcaagacaaaaagtaaaagattgaagggatttgatcctatagttactttagtcacatatacacttttgctttttcaattttttttccttttctcgtctcaaatccccatatctaaagcagacccacctcaaagttttgaattctctttaccaggttcacatataattgactcattgacagtagatagtgacaaaaagtaaagctttcaatatcaaactaaagaaacattctttgtttttaaacccattagaagaatcatctgaaatgtcttggaaggaattagagaaatctccaaccaaactattcagggtttaaagtggtgttatacttatagtatgtaaaaagagtaaataatcacttactctttttcttcttggtgaaggttcctccaacatgcctgctcttcatcttcaacataacctataagttcaataaatcaaaacaaattagtgattctgtaagagatgcttaagcagcaaagacaaaagtggatcccatgatttcagtatcatcatcattatcaaaacagtgctttttatttttaagctttagtattgtttctactttctcttcttttcctgccgtttgaaatttctcttttctcatctttttgtgtgtttcatataacaaagttaacatccatgtgaagtaactaaagattcccactgattcacaaataatttggctctctttaatctttttcatcagatcaacaacgatcatttcctaaagtgaaacgaaactcgaggcacaataagaaaaagaatctttacctgattcattttgttgatgtaaacagatactatcttccagtggagatcacctgcaaaagtcacacatcattagacaaaagattcaacaactaaaatttaaacttttaaatacacaagtttgaatttttcttacctttgcgagtgcgtttgaggagttcacaacctctagcgagccattctctactacaagttcccaagaaattctcctgttgtacaagttcaccactgtgactactgcttgagcttccattgctaccattaacattattgctgcttcctcctgtagaagtgagtcctttatccattggtatcactgatgctatgttccacacttccttcattgcccttgccttcaatgtttgcactcctcttaaagctacacaccaaaaatacaaatcaaattaccaaaaattaacttctgattccttcataaagttccaattttgagccaatccctaaatcaatgctatcattatcttcaacaaaatcaaaactttagcaattctcattacagggtcaagaagtattaaacatgtttcaacctaaagtcaatcaattttagcgttttcttttgaaagttccaaactttatcaaaactctgtactaaacaaacctgtagctgctccggcggtgagagtcataatatctccggcagaacgaacattgacggcggagctaacaacagaagccaaatactctctctcagctcccataacttcagcagcttccacacactgagcagccacaagggtcgcagcagaagcaacggccatgtcagttttagccatctgctcatccttaccacagctagaagacgcagcggtggctgctgcaatagcagcaacagctgcagcaacgccggcgacagagacagcagcgtgaatctgagcgttatgagcccgagtctcctctttctttttctctctccggtccttaagccaccgtcccaccgtcttggactgtgtagctgtagcggttataggtcccggagttgccgccgttgaacggaactgagaatttacactgttcaatgaatttttgttcgctctgcaaaattgctgcattttaagattaaaaatttgagttttagtatcagagattcgccagaacccagaagagtgaagcaaaatctaaaaaaggaaatgtttttggaagaagagtgatgaacaagaaaaagacaaaaccaaatcaagtaaaggagattgctttagaccaaagtgtcactaaataatacttatttaattaagaaaaccaacaattcgttaatgggtttaaggaataattataaaattgaattgaaatgatgaagaatcatcggaaacagtagtgggagaaagacatgatctctgggtatggttggataaagagaaagcttctagtgaagattctttttttattttcacagtctctcattgtacccaaaattgtcagtgacgcagtaaaaattgaaacatttacatagagagtaacaccaaaactcagaaacccagaacatgctttagtatcaaaactaaatacagttttggtcaagaaattggaaccttaatgtcgtcggattcgggaggagacacaggaggactgtcggtcaaagaaccattaagtggaccactactgtgagatagccgaccagatgttcttggtgatacttcttgctgcaaacaaaattattaaagaagatgagacaaaagtagaatcaagaagaagagatgatgacaaatccataaacttgttattatgtttttagggacccagaaagcgagtgtgtagataaaaatcgtaactttttttcttgattaatagttataattattgcgcgtgaaaattttctcttcattaatcacacttaataaagagagattcatgaacataatttgctaaaaattaaaactttgattgaccatatttgggaaattctgatgaaagaaacaaaataaaatttgtcaacatcgaaagtaaaaaaaaaaagaatgctttgttttgtccggaaatgctctgtttttatctgaagaaaagacttacagagtgagacaagatacgatccatgaccatttgagaagtttctgaacaagcgaaggagaatgggtttccggtgacaagtccggtgtcttccgtgtcgccgtcgccgtctacgacagaggagatgggttcttcttcttcttcttcttcggttttggagaggagaatctgagggttgggtggtgttagagccttggagacttcgagagcagagacgctccatgaacgagctaaaaactccatcggttcgagtggtgtttccggtggacggtaaaccgggtcgggtctccatgtcggaaccatgagtttttccat

SEQ ID NO: 931 - DNA, 3380 bp, Arabidopsis thaliana; identical to SEQ ID NO: 930
  G599 DNA sequence used for BLAST

SEQ ID NO: 932 - DNA, 1501 bp, Arabidopsis thaliana
  G603 cDNA Sequence
tcttgaaacacttcaaatctccggtcaacaaaaaccatgacttcaatttcttaaacaaaaagtttcaatctttttccaaacaaaacccatttcagattttgttctttgagaaaccaacatgagaaagacttctgtttcatctaatagctttggtgggtttttaagtcccggagctccgagttacgctgacaacaaaggttggagctccgagagagttcctcatccttcctccactacttcctcctctgcaattaacggtggtcgtcgtcacatcggctcttcttccgctttaacgacgccgttttacagcggcagagcaattccttcgaaatgggaagatgctgagcggtggatttgtagccctgtgtcgacttacccacaaggtgtttgtttaaattcctcagtgagttctgaacagagaaggcagaaatctaaaagtggtccgattgttcctcctacgttgcctcatccgcatcctacgtcttcttcgtcggcgactgggtgttatcactattctccgaggatgatgatgcggtctatggatgctcctcctaagggtttaatggttgctggttctccgttttctactggagttttggaggcggatagggtttttagaggaagtgtcggtggtggtggttgtgatggctatggtcgtggacctggccatggacatagccggagctgggttgatttgatgagtgaagaaacttcttcacttagctccaaaactgatacagaggagaaagcagagatgacgacggcgatgcaatctccggtggtatcaagaagagatatggctactcagatgagtccagaagagacgagtcctaataacaataaccagtctccaccattggttgtttctgtgattgagccacctccttgtagaggtgaagtgagagaagtgaaaatggataaaggagcaagaatgattaagcgtccaaagagacgagtcatgtcttctaggattattaggagagagcaacctgaggttgaagacaattctgaagcttctgcttcttcttcttcttgggatatctcagaaccagccatgactctttctaagttgcaaagagaggaagcgaagattgcagcttgggaaaatctgcagaaggcgaaagcagaagccgctattagaaaacttgaggtgaagctggagaagaagaaatcagcatcaatggataagatcttgaacaagcttcaaacagctaagatcaaagcacaagagatgaggagaagttcagtatccagtgaacatgaacaacaacaagggaatcatcaaatctccagaaactcggtgaagatcacgcatcttgttcgaagacatactttcatgactcctttcatgacttgctttgctcctcgtgttgattgcagaaaatcttcttctgctctctgaatttttttattgaaaagacaatttgatcaaaagaaaaaaaaatgtacactgcgaatttttcttgtaaagctttctctgttccaacaaaaaaaaaaaaaa

SEQ ID NO: 933 - protein, 427 aa, Arabidopsis thaliana
  G603 Amino Acid Sequence
MRKTSVSSNSFGGFLSPGAPSYADNKGWSSERVPHPSSTTSSSAINGGRRHIGSSSALTTPFYSGRAIPSKWEDAERWICSPVSTYPQGVCLNSSVSSEQRRQKSKSGPIVPPTLPHPHPTSSSSATGCYHYSPRMMMRSMDAPPKGLMVAGSPFSTGVLEADRVFRGSVGGGGCDGYGRGPGHGHSRSWVDLMSEETSSLSSKTDTEEKAEMTTAMQSPVVSRRDMATQMSPEETSPNNNNQSPPLVVSVIEPPPCRGEVREVKMDKGARMIKRPKRRVMSSRIIRREQPEVEDNSEASASSSSWDISEPAMTLSKLQREEAKIAAWENLQKAKAEAAIRKLEVKLEKKKSASMDKILNKLQTAKIKAQEMRRSSVSSEHEQQQGNHQISRNSVKITHLVRRHTFMTPFMTCFAPRVDCRKSSSAL

SEQ ID NO: 934 - DNA, 2100 bp, Arabidopsis thaliana
  G603 Genomic Sequence
cccaaatagagatttgtttggcttttcctctatttttcattattcggacaagccacgacacttgtcttaatgccaccaaaaaaaaaaaaaaaatcactcacatcatctctcttccctcaaagttctcaccttttgagattattacaaagaacacaaaagtacagtttctttattcccttttttgaacactttaaacatcatcactcttgaaacacttcaaatctccggtcaacaaaaaccatgacttcaatttcttaaacaaaaagtttcaatctttttccaaacaaaacccatttcagattttgttctttgagaaaccaacatgagaaagacttctgtttcatctaatagctttggtgggtttttaagtcccggagctccgagttacgctgacaacaaaggttggagctccgagagagttcctcatccttcctccactacttcctcctctgcaattaacggtggtcgtcgtcacatcggctcttcttccgctttaacgacgccgttttacagcggcagagcaattccttcgaaatgggaagatgctgagcggtggatttgtagccctgtgtcgacttacccacaaggtgtttgtttaaattcctcagtgagttctgaacagagaaggcagaaatctaaaagtggtccgattgttcctcctacgttgcctcatccgcatcctacgtcttcttcgtcggcgactgggtgttatcactattctccgaggatgatgatgcggtctatggatgctcctcctaagggtttaatggttgctggttctccgttttctactggagttttggaggcggatagggtttttagaggaagtgtcggtggtggtggttgtgatggctatggtcgtggacctggccatggacatagccggagctgggttgatttgatgagtgaagaaacttcttcacttagctccaaaactgatacaggtaactatagtttctttctctctctctctctcttatcttcttaatgaatctgaaattagacctctttgaatcttgcttttggcaaattgaatcacagaatcatgaaaagattcaagcttgagctggttcttatgaaaccatgttcaaagatctaagctatgtttgattctgaaatttgtgtagaggagaaagcagagatgacgacggcgatgcaatctccggtggtatcaagaagagatatggctactcagatgagtccagaagagacgagtcctaataacaataaccagtctccaccattggttgtttctgtgattgagccacctccttgtagaggtgaagtgagagaagtgaaaatggataaaggagcaagaatgattaagcgtccaaagagacgagtcatgtcttctaggattattaggagagagcaacctgaggttgaagacaattctgaagcttctgcttcttcttcttcttgggatatctcagaaccagccatgactctttctaagtaatcaaagttgttgtatcagttttttataacgctttcttcttggtcagccattaatgtgagtatttgcaggttgcaaagagaggaagcgaagattgcagcttgggaaaatctgcagaaggcgaaagcagaagccgctattagaaaacttgaggtcagtcctccttcacttacttacataagctcctcacaaaccaatcagaggttattatgtattgaaatttcatttggcttgactgaatcaaacaggtgaagctggagaagaagaaatcagcatcaatggataagatcttgaacaagcttcaaacagctaagatcaaagcacaagagatgaggagaagttcagtatccagtgaacatgaacaacaacaagggaatcatcaaatctccagaaactcggtgaagatcacgcatcttgttcgaagacatactttcatgactcctttcatgacttgctttgctcctcgtgttgattgcagaaaatcttcttctgctctctgaatttttttattgaaaagacaatttgatcaaaagaaaaaaaaatgtacactgcgaatttttcttgtaaagctttctctgttccaactttttacttgtttgcataatacaccacacaaagtaggttcactggttccgagggtaaaa

SEQ ID NO: 935 - DNA, 1386 bp, Arabidopsis thaliana
  G603 DNA sequence used for BLAST
atgagaaagacttctgtttcatctaatagctttggtgggtttttaagtcccggagctccgagttacgctgacaacaaaggttggagctccgagagagttcctcatccttcctccactacttcctcctctgcaattaacggtggtcgtcgtcacatcggctcttcttccgctttaacgacgccgttttacagcggcagagcaattccttcgaaatgggaagatgctgagcggtggatttgtagccctgtgtcgacttacccacaaggtgtttgtttaaattcctcagtgagttctgaacagagaaggcagaaatctaaaagtggtccgattgttcctcctacgttgcctcatccgcatcctacgtcttcttcgtcggcgactgggtgttatcactattctccgaggatgatgatgcggtctatggatgctcctcctaagggtttaatggttgctggttctccgttttctactggagttttggaggcggatagggtttttagaggaagtgtcggtggtggtggttgtgatggctatggtcgtggacctggccatggacatagccggagctgggttgatttgatgagtgaagaaacttcttcacttagctccaaaactgatacaggtaactatagtttctttctctctctctctctcttatcttcttaatgaatctgaaattagacctctttgaatcttgcttttggcaaattgaatcacagaatcatgaaaagattcaagcttgagctggttcttatgaaaccatgttcaaagatctaagctatgtttgattctgaaatttgtgtagaggagaaagcagagatgacgacggcgatgcaatctccggtggtatcaagaagagatatggctactcagatgagtccagaagagacgagtcctaataacaataaccagtctccaccattggttgtttctgtgattgagccacctccttgtagaggtgaagtgagagaagtgaaaatggataaaggagcaagaatgattaagcgtccaaagagacgagtcatgtcttctaggattattaggagagagcaacctgaggttgaagacaattctgaagcttctgcttcttcttcttcttgggatatctcagaaccagccatgactctttctaagtaatcaaagttgttgtatcagttttttataacgctttcttcttggtcagccattaatgtgagtatttgcaggttgcaaagagaggaagcgaagattgcagcttgggaaaatctgcagaaggcgaaagcagaagccgctattagaaaacttgaggtcagtcctccttcacttacttacataagctcctcacaaaccaatcagaggttattatgtattgaaatttcatttggcttgactgaatcaaacaggtga

SEQ ID NO: 936 - DNA, 1263 bp, Arabidopsis thaliana; identical to SEQ ID NO: 79
  G605 cDNA Sequence

SEQ ID NO: 937 - protein, 334 aa, Arabidopsis thaliana
  G605 Amino Acid Sequence
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 938 - DNA, 1694 bp, Arabidopsis thaliana
  G605 Genomic Sequence
atgtatttcttcttcctccttgatttttaatctgatttttaacctttggatttggaaaattatatcttcttctgtcccaaatctatttttaggtttgtcaaaacgattattttgtttaataatcgtaataggtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtaactatagatttttaaattttttgctaatcttgtgtctaaatctatgttttgtttagaactgaatcttgagttctcgtgacttcaaaagtgtttaaaagagattttttgggatctttctgggtcttaagttgaaacatgcaaagaaagaaagcttctacttcaagtggtgggacctcttattacaactttttgtccgtacatatacggtcatatatacatgtatatatacggtataataataattgcatgtttattgaagagatttttggtgatgttgttttgtgcttgtgaaggtgaatggtctccttcctctgccgccgctaatttcacgccgcatattattacggtgaatgcaggcgaggtaattatgacaaaataaatatagattaagaatgtgtttatttttagagtagttgatgatttagtgggtaatttggttttataggacgttacgaagaggataatatcattttctcaacaagggtctctagctatttgcgttttatgcgcaaacggtgtcgtttcgagcgttacacttcgtcagcctgattcatctggtggtacattgacctatgaggtacggtttccatcttaatcactatttgcatagatgaaaaacactgttaccaaactgtattaataaaccatcaatgtaaacaaccgaaccggaatataaaaccgagttgcctatcccttgcttttggttttcatgtaattcttgttgatcatgacgagtgcttatgctttttaaagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtga

SEQ ID NO: 939 - DNA, 1561 bp, Arabidopsis thaliana
  G605 DNA sequence used for BLAST
tcacgtcaaagtgatattaaagtcatgagaatgcttgtgtcgtgaatcagaaggaaaagacggtgtccatgtactgatcgggagactagatgtcatgggacggatggttcgatgatcagctacattcgaagaagttggcattaatggagaagacatgaagttgtggttatgcggcttcggtgtctgttcttgctggtttgttccacctaagaaagttcctacaaccacttgaataggagtggctgcaaccagcaagccagcaacaccaccacctactacacgtccatcagggctagcaagcgacacgctcatcccgcctgttctgcttcgtgtcccgtctgagtcactaggcatgaatgttccagatagtgacaatatctcaaaccgaccctttaaaaagcataagcactcgtcatgatcaacaagaattacatgaaaaccaaaagcaagggataggcaactcggttttatattccggttcggttgtttacattgatggtttattaatacagtttggtaacagtgtttttcatctatgcaaatagtgattaagatggaaaccgtacctcataggtcaatgtaccaccagatgaatcaggctgacgaagtgtaacgctcgaaacgacaccgtttgcgcataaaacgcaaatagctagagacccttgttgagaaaatgatattatcctcttcgtaacgtcctataaaaccaaattacccactaaatcatcaactactctaaaaataaacacattcttaatctatatttattttgtcataattacctcgcctgcattcaccgtaataatatgcggcgtgaaattagcggcggcagaggaaggagaccattcaccttcacaagcacaaaacaacatcaccaaaaatctcttcaataaacatgcaattattattataccgtatatatacatgtatatatgaccgtatatgtacggacaaaaagttgtaataagaggtcccaccacttgaagtagaagctttctttctttgcatgtttcaacttaagacccagaaagatcccaaaaaatctcttttaaacacttttgaagtcacgagaactcaagattcagttctaaacaaaacatagatttagacacaagattagcaaaaaatttaaaaatctatagttacctaaattctcgacctggtactttggcctgatgaatgagcttggagttggagttgctggtttcattttgccacgtttctccgatgtcgtcgagaaatcgatgacgtgagaagtcgttggtgcggctgatgatatcggattcggagatagcgtcaccgctgctccgtcgtgtccgtacttcctagggcgcccacgtctcttctttatcggtccgcttgagaaaccatccatagccgccgacggagtaaaggagttttgcggcggtggaggaggaggaggagcgacggagttgggaggtgtgtttgaagtttctgacctcggagccatgtggaagtctgacggcgcgttggatctcaccaccgtaacgcctccgtcgctcccggtggttgttttaacaacttctccggtagtctccat

SEQ ID NO: 940 - DNA, 1642 bp, Arabidopsis thaliana
  G607 cDNA Sequence
aacgccgttaaaacgattctttcccattgtatccgcttttaacaactctcgtcgtcatctccaccgtccgttttctctcagctatattttaatggcgacaattcagaagcttgaagaagttgcaggcaaagatcaaactctaagagccgttgatctaaccatcatcaacggcgtcagaaacgtcgaaacttcaagacctttccaagtaaatcccacagtgagtctcgagcccaaggcggagccggtgatgccgtcgttttcaatgtctttagctccaccgtcttcgacaggaccaccattgaagagagcttcgactaaagaccgtcacacgaaggttgaaggaagagggagaaggatacggatgcctgccacgtgtgcggctaggatttttcaattaactcgagagttaggtcacaaatccgacggcgaaacgattcggtggttgttggagaacgctgagccggcgattatagccgccacgggtacgggaacggttcccgccatcgccatgtcggttaacggaaccttaaaaatcccgacgacgacgaacgctgattctgatatgggtgaaaatctgatgaagaagaaacgtaaacgaccttctaacagtgagtatatagacataagcgacgccgtttcagcttcctccggtttagctccaattgccacgacgacaacgatccaacctccgcaagctctggcatcatccactgtggctcagcaacttctgccgcaaggaatgtatccgatgtgggctattccatcaaacgcaatgattccgacggtcggagctttcttcttgattccacaaatcgctggtccgtcgaatcagcctcagttattagcttttcccgccgccgctgcttcgccgtcgtcttacgtcgccgctgttcaacaggcttccacgatggctagaccacctcctttacaagttgttccaagcagcggctttgtatccgtttcagacgttagcggttcgaatttatcaagagcgacgtcggttatggctccgagctcaagctcaggcgtaacaaccggtagttcatcgtcaattgcaacaacaacgacgcacacgctgagagacttctccctagagatatacgagaaacaagagcttcaccagttcatgagcaccacaacagcacggtcatcgaaccactgaagaaaagaaaggaaacggcggcgtattagtgatcggaaaaaaagcacgtgtgcacatgaagaagtgcacgtgttaagaagtgggcctcgattttaggcagaagtgggtcaacacgcaccaaaaagagagtggagggaggaggagaggggccacacggctcccaccttacgcatagcttccgaggcagccaggttgggtgtggtccccaaatggttagagctacgtggtccgtatgagtaggaccagcttaagcttaagcataattcgaaacgtttcgtttttttggtgggggctcaccactttgtcttgacttttttggtctttgtaattttacaaaataagatttattgaagccctctctaagtcatggtccactcaacaacaattgtgatattgatgttttgattttattaaaatctgtaacaaaataaatatttctatctaaaatgaaaatactaatgttgttttcctaaaaaaaaa

SEQ ID NO: 941 - protein, 356 aa, Arabidopsis thaliana
  G607 Amino Acid Sequence
MATIQKLEEVAGKDQTLRAVDLTIINGVRNVETSRPFQVNPTVSLEPKAEPVMPSFSMSLAPPSSTGPPLKRASTKDRHTKVEGRGRRIRMPATCAARIFQLTRELGHKSDGETIRWLLENAEPAIIAATGTGTVPAIAMSVNGTLKIPTTTNADSDMGENLMKKKRKRPSNSEYIDISDAVSASSGLAPIATTTTIQPPQALASSTVAQQLLPQGMYPMWAIPSNAMIPTVGAFFLIPQIAGPSNQPQLLAFPAAAASPSSYVAAVQQASTMARPPPLQVVPSSGFVSVSDVSGSNLSRATSVMAPSSSSGVTTGSSSSIATTTTHTLRDFSLEIYEKQELHQFMSTTTARSSNH

SEQ ID NO: 942 - DNA, 1071 bp, Arabidopsis thaliana
  G607 Genomic Sequence
tcagtggttcgatgaccgtgctgttgtggtgctcatgaactggtgaagctcttgtttctcgtatatctctagggagaagtctctcagcgtgtgcgtcgttgttgttgcaattgacgatgaactaccggttgttacgcctgagcttgagctcggagccataaccgacgtcgctcttgataaattcgaaccgctaacgtctgaaacggatacaaagccgctgcttggaacaacttgtaaaggaggtggtctagccatcgtggaagcctgttgaacagcggcgacgtaagacgacggcgaagcagcggcggcgggaaaagctaataactgaggctgattcgacggaccagcgatttgtggaatcaagaagaaagctccgaccgtcggaatcattgcgtttgatggaatagcccacatcggatacattccttgcggcagaagttgctgagccacagtggatgatgccagagcttgcggaggttggatcgttgtcgtcgtggcaattggagctaaaccggaggaagctgaaacggcgtcgcttatgtctatatactcactgttagaaggtcgtttacgtttcttcttcatcagattttcacccatatcagaatcagcgttcgtcgtcgtcgggatttttaaggttccgttaaccgacatggcgatggcgggaaccgttcccgtacccgtggcggctataatcgccggctcagcgttctccaacaaccaccgaatcgtttcgccgtcggatttgtgacctaactctcgagttaattgaaaaatcctagccgcacacgtggcaggcatccgtatccttctccctcttccttcaaccttcgtgtgacggtctttagtcgaagctctcttcaatggtggtcctgtcgaagacggtggagctaaagacattgaaaacgacggcatcaccggctccgccttgggctcgagactcactgtgggatttacttggaaaggtcttgaagtttcgacgtttctgacgccgttgatgatggttagatcaacggctcttagagtttgatctttgcctgcaacttcttcaagcttctgaattgtcgccat

SEQ ID NO: 943 - DNA, 1071 bp, Arabidopsis thaliana; identical to SEQ ID NO: 942
  G607 DNA sequence used for BLAST

SEQ ID NO: 944 - DNA, 2311 bp, Arabidopsis thaliana
  G610 cDNA Sequence
tcttaatcagagattcgtgagaggtaaaggtagcgtaattattcagtttgcgtgatctataatttaactggcgccagattgtgatccaggaatcgttggcttgttaggttgttgttttgttatgcataattgagagatggtggtcaaaaggaagttaaattgtggtggctctgatggttttgatttccccaatattcccaaggctcctcgttcaagcaggaggaaggtctcaggtaagagatctgatgatgaaagtgagatctgtgcaattgatttgctagcttctcttgctggaaagttgttggaagaaagtgaaagttcctcaacgtctacctatgcatctgaagctgataatcttgatcatttgggtggactgattaagcaagaacttgaagatggctatactactaagccttgtaaatccgagtttttcgatccaggaaaccctgcttcaaagtccactagtgaaaatactagcgtgacttgtttgccattttcgtctttcgaaaatgattgcattttggagcaaacaccagtttctgattgtaagagggcatctggtttgaagtccctggtagggagcatcactgaggagacatgtgttgttaatgaggatgccggatctgaacaaggtgctaatactttcagcttaaaggatccaagtcaattacattcgcagtctccagaatcggtccttctggatggcgatgtgaaattagcaccatgcacggatcaagtccctaatgattcttttaaaggatataggaatcattctaagttagtttgcagagatgatgacgaaaactattgtaagtattataaatttagtgacaaatgtaagtcatataggcctctctcccgggttggcaatagaagaataatgcagtcggtgagagcaatctccaagttgaagtgttttgaagacactagaacagatggtcgtttgaaggctctctaccgcaagagaaaattatgttatggttacaacccatggaagcgtgagaccattcataggaagagaagattgtctgacaaaggtttggtcgtaaattatgatggtgggctcagtagtgaaagtgtttccaattcacctgaaaagggagaatcagaaaatggtgatttctctgctgcaaaaataggtcttctttcgaaagactcccgtgtaaagttcagcatcaagtcccttaggattccggagcttgtaattgaagttccagaaacagcaacagtaggcttactgaagaggacggtgaaggaggcggttactgctttactcggtggtggaatacgtattggggtgttagtccaagggaaaaaagttagagatgacaacaacactctatcacagactggtctttcgtgtagagaaaatcttggcaaccttggcttcaccttagagcctggtttggaaacactgcctgtacctctttgttctgaaactcctgtcctttctctgccaactgactctacaaagttgtcagaaaggtccgcagcttctccagcgttagagactggaattcctctccctccccaagatgaagattacttgattaatttgggaaatagtgtggagaacaatgatgaattagtcccacatctgagtgacataccagctgatgaacaaccttcatcagattcaagagcgctggttccagttttggccttggagtccgacgctcttgcacttgttccagttaacgagaaacctaagcgtacagagctttcacaacgcagaaccaggagactattctctgttacagaggtagaagctctagtaagcgcagttgaagaagttgggactggaagatggcgtgatgtgaagttgcgttcttttgagaatgcaagtcatcgaacctatgtggacttgaaggacaaatggaaaacgttggttcacacagcaagtatatcaccacagcaacgaagaggagaaccagtgcctcaagaactgctagacagagtcttaggagcacataggtactggacacagcaccaaatgaaacagaacgggaaacatcaggtggctacaacaatggtggttgaagcaggttcgtccatgtaaagaaggagaatggtagtaacaataactttcacttgacgactaaggaaccaaagtgggcaactgtacaaagggaaacaacaaaatacagaaacatacttaatttctgaaaagaagagtctatatttttattttttttaaatcatagccggtagaaacaagacgttccttgacacttttggttacttttatggtaggtctgttcattccaaatttctaattgatttgattatgtaatttggtggtaggaccatg

SEQ ID NO: 945 - protein, 640 aa, Arabidopsis thaliana
  G610 Amino Acid Sequence
MVVKRKLNCGGSDGFDFPNIPKAPRSSRRKVSGKRSDDESEICAIDLLASLAGKLLEESESSSTSTYASEADNLDHLGGLIKQELEDGYTTKPCKSEFFDPGNPASKSTSENTSVTCLPFSSFENDCILEQTPVSDCKRASGLKSLVGSITEETCVVNEDAGSEQGANTFSLKDPSQLHSQSPESVLLDGDVKLAPCTDQVPNDSFKGYRNHSKLVCRDDDENYCKYYKFSDKCKSYRPLSRVGNRRIMQSVRAISKLKCFEDTRTDGRLKALYRKRKLCYGYNPWKRETIHRKRRLSDKGLVVNYDGGLSSESVSNSPEKGESENGDFSAAKIGLLSKDSRVKFSIKSLRIPELVIEVPETATVGLLKRTVKEAVTALLGGGIRIGVLVQGKKVRDDNNTLSQTGLSCRENLGNLGFTLEPGLETLPVPLCSETPVLSLPTDSTKLSERSAASPALETGIPLPPQDEDYLINLGNSVENNDELVPHLSDIPADEQPSSDSRALVPVLALESDALALVPVNEKPKRTELSQRRTRRLFSVTEVEALVSAVEEVGTGRWRDVKLRSFENASHRTYVDLKDKWKTLVHTASISPQQRRGEPVPQELLDRVLGAHRYWTQHQMKQNGKHQVATTMVVEAGSSM

SEQ ID NO: 946 - DNA, 2659 bp, Arabidopsis thaliana
  G610 Genomic Sequence
catggacgaacctgcttcaaccaccattgttgtagccacctgatgtttcccgttctgtttcatttggtgctgtgtccagtacctatgtgctcctaagactctgtctagcagttcttgaggcactggttctcctcttcgttgctgtggtgatatacttgctgtgtgaaccaacgttttccatttgtcctgcaacaaatcacaaagttattggaaccatttatgtagtggctaagactcaaaagtgtgtttgaccagtttctgatatgtgttctcataccttcaagtccacataggttcgatgacttgcattctcaaaagaacgcaacttcacatcacgccatctgtgaaataagaatatctatcattagtttgaccacataaccaaattattgtattaataaccctcatcaaccaaaccagtctttttaccttccagtcccaacttcttcaactgcgcttactagagcttctacctctgtaacagagaatggtctcctggttctgcgttgtgaaagctctgtacgcttaggtttctcgttaactggaacaagtgcaagagcgtcggattccaaggccaaaactggaaccagcgctcttgaatctgatgaaggttgttcatcagctggtatgtcactcagatgtgggactaattcatcattgttctccacactatttcccaaattaatcaagtaatcttcatcttggggagggagaggaattccagtctctaacgctggagaagctgcggacctagcaagatcgaatgattgtccttaggtatatctctagagcttcaaatttatccatacacaagcaaaacttgcagtaacaaatatatatatatatatatataagatcacgtttgttagtacctttctgacaactttgtagagtcagttggcagagaaaggacaggagtttcagaacaaagaggtacaggcagtgtttccaaaccaggctctaaggtgaagccaaggttgccaagattttctctacacgaaagaccagtctgtgatagagtgttgttgtcatctctaacttttttcccttggactaacaccccaatacgtattccaccaccgagtaaagcagtaaccgcctccttcaccgtcctctgcaaccaaaaaggtttatgtaaataacacttcatcattgtacacagcagaaccaaaacatctacagagaccggtaggaaaagacatttaatcacgcaccttcagtaagcctactgttgctgtttctggaacttcaattacaagctccggaatcctaagggacttgatgctgaactttactgcaaacaatgaaataacatgagacccacatatcatgtctccataagtcagtaaattatcaactgatcatataccacgggagtctttcgaaagaagacctatttttgcagcagagaaatcaccattttctgcattcaacaaagaagcaaaaaaatcatgaaatcaaaaccatatcagccaaggtaataaaccatctagatatagactaatatgtacctgattctcccttttcaggtgaattggaaacactttcactactgagcccaccatcataatttacgaccaaacctttgtcagacaatcttctcttcctatgaatggtctcacgcttccatgggttgtaaccataacataattttctcttgcggtagagagccttcaaacgaccatctagaaatatatccgcaagcaaagtaagggcagagcggcagctaaaaagaaatgcaccaaggagaaacacagtaatatgatactaacctgttctagtgtcttcaaaacacttcaacttggagattgctctcaccgactgcattattcttctattgccaacccgggagagaggcctatatgacttacatttgtcactaaatttataatacttacaatagttttcgtcatcatctctgcaaactaacttagaatgattcctatatcctttaaaagaatcattagggacttgatccgtgcatggtgctaatttcacatcgccatccagaaggaccgattctggagactgcgaatgtaattgacttggatcctttaagctgaaagtattagcaccttgttcagatccggcatcctcattaacaacacatgtctcctcagtgatgctccctaccagggacttcaaaccagatgccctcttacaatcagaaaccggtgtttgctccaaaatgcaatcattttcgaaagacgaaaatggcaaacaagtcacgctagtattttcactagtagactttgaagcagggtttcctggatcgaaaaactcggatttacaaggcttagtagtatagccatcttcaagttcttgcttaatcagtccacccaaatgatcaagattatcagcttcagatgcataggtagacgttgaggaactttcactttcttccaacaactttccagcaagagaagctagcaaatcaattgcacagatctcactttcatcatcagatctcttacctgagaccttcctctacaaaagggaaacaaaagtcatcagagacgtattacaaaagcatacaaaaaaaaaaacaaaaaaaatgaagaccatgatctcttaccctgcttgaacgaggagccttgggaatattggggaaatcaaaaccattagagccaccacaatttaacttccttttgaccaccat

SEQ ID NO: 947 - DNA, 2659 bp, Arabidopsis thaliana; identical to SEQ ID NO: 946
  G610 DNA sequence used for BLAST

SEQ ID NO: 948 - DNA, 1519 bp, Arabidopsis thaliana; identical to SEQ ID NO: 58
  G615 cDNA Sequence

SEQ ID NO: 949 - protein, 351 aa, Arabidopsis thaliana
  G615 Amino Acid Sequence
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 950 - DNA, 1080 bp, Arabidopsis thaliana
  G615 Genomic Sequence
atgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttctattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtaaagtttggattcaagactcttttgtaaactaa

SEQ ID NO: 951 - DNA, 1080 bp, Arabidopsis thaliana; identical to SEQ ID NO: 950
  G615 DNA sequence used for BLAST

SEQ ID NO: 952 - DNA, 1431 bp, Arabidopsis thaliana; identical to SEQ ID NO: 2
  G616 cDNA Sequence

SEQ ID NO: 953 - protein, 360 aa, Arabidopsis thaliana
  G616 Amino Acid Sequence
MKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 954 - DNA, 1098 bp, Arabidopsis thaliana
  G616 Genomic Sequence
tcagttcttgcctttacccttatgttctgatgagtttctgcatccattttcatagtaaagctgaaactggtgattgtggtggtgattctctgcaggcagtgcaccgaataagaactgtggacctcctccactttctgatgttggaaacctctgtagattagcgaggaatgactgatgctgatttgttgaattggactgaagggtccccctgttgaaaccactgaagccaccacctgatgcggcggagacggcagctccggcgccggagggtgttgacatattaaaatcaagattgaatgctccgccgttggattctgccggtgatatcaaatggtcgggaacgaatgaaaactcttgatgctgatgatgaggatgatgatgatgatgatcggagattgatgagaaaggatgagaatttgttgaaatagggaaatgggtttgttgacccgacccgagaattaaacccgaactgaaatactccattggagatgaagaaggagctgaagccatccattgccggtttgagttaaccggatctgaaccggaatttaacaaatccgtaaacgaagtgtggttatgatctctttccttggtctctttagctgttctctctctagccctctctctagctttatctctaagctccgatcttgataaagacaaaccagaagagttcttgctcgtgtctgaattgctactacaagcagatttagacaaggaattagcagcaactgttgttaatgtctgattctggtgattctcgtcatcggtcggaaaatgagtgttgttgagtgaaggaagctcagagattgaatcttcagcagctttgattaaccattcaacagctttgctaggttgatcataacctaaccgatcttgaagatcatagaattgaagagcggtggagactgataaccggacacgacggtcacgtggtcctttagaagtcaagactttgctgtgtcgatctttaccaccggaagctcgtgaaaccctaattatccgggaagaattgtgatgccaccggcttaaccggttgttcacttcgttatccacaacgtcgccattgttgttattcttcattagatctccaatcat

SEQ ID NO: 955 - DNA, 1098 bp, Arabidopsis thaliana; identical to SEQ ID NO: 954
  G616 DNA sequence used for BLAST

SEQ ID NO: 956 - DNA, 1557 bp, Arabidopsis thaliana
  G629 cDNA Sequence
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 957 - protein, 368 aa, Arabidopsis thaliana
  G629 Amino Acid Sequence
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 958 - DNA, 1649 bp, Arabidopsis thaliana
  G629 DNA sequence used for BLAST
atgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaaggttaactagttttcttctttcaagattcattgatttttgaaagttgttgttacttgtttttttactaatgggtttttaaatcacgtgcagataaattatgattcttctcataaccagatcgaagcagaacaaccttctagtaatgataatcaagatgatgatggcaggattcatgataaggtttagatcaaaacaaagctaattatgttttcttttttatacatgcataatagaaaatggtggtttttgtgatattgattgatattcttttgtcatatgccaatagatgaaacggcgtttagcgcagaaccgagaagcggctcgcaaaagtcgtttgagaaagaaggtagaagcaagtccctttattgaatctcatatagtttagttagttgctactaagtcctctttttttttgtatctttaggcttatgttcagcagttagaggaaagccggttaaagttatcgcagttagagcaagaactcgaaaaggttaagcagcaggtgagctaggtcaaaagatatgtttaaaatgttctgttttgagtctctatcaagaaaatcagttttggtttcgtaattgactcagtactaaatgttttctttcaagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccaaatgaaatccgatgcagcaaaagccgatgttttctacttgatatcgggaatgtggcgaacttcaaccgaaagattcttccaatggattggagggtttcgtccatccgaacttttaaacgtaaaaatacccaaaatgttacaatctctaacaaaaacattttcaaaatgtaatattttctccttcccttttcttgtaggttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagtaagtagtaaacattaactcaaaacaaattaagtaaagtttgtgtcattctatttcaaacatctctatcctgattataacaggcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaa

SEQ ID NO: 959 - DNA, 759 bp, Arabidopsis thaliana
  G630 cDNA Sequence
gagagaaattgaccatgcagccaaattatgatagctcaagtcttaacaacatgcaacaacaagactacttcaacttgaacaactactacaacaacttaaacccttcaaccaataacaacaacctcaatatcctccaataccctcaaattcaagaactcaacctacaatctccggtaagcaacaactccacaacttccgatgacgcaactgaagaaatcttcgtcatcaacgagaggaagcaaagacgtatggtatctaacagagagtcagcaagaagatcaagaatgagaaagcaaagacacttagatgagcttctctcacaggttgcttggcttcgaagcgagaaccaccagcttttagataagcttaaccaagtctccgacaacaatgatcttgttattcaagagaactcgagtcttaaagaagaaaacttggagcttcgtcaggttatcacatccatgaagaagcttggaggaggcatacatgacaaatattcttctccgtcgtctatggatgaattggatcaagacttttcttctatcacagatgatccaagaactcatcatccatcatgagttgttctgatcgagaaaaacattacttcaagtttctgcctctaatcttatctattttctttctttggtatcactttttaaaccgtttaactacgtaccaaagtttgggttttatttgtttttctgttgttttgtcagaagataattaaatgatggatatttgaaaaaaaaaaaaaaaaaaaaa

SEQ ID NO: 960 - protein, 186 aa, Arabidopsis thaliana
  G630 Amino Acid Sequence
MQPNYDSSSLNNMQQQDYFNLNNYYNNLNPSTNNNNLNILQYPQIQELNLQSPVSNNSTTSDDATEEIFVINERKQRRMVSNRESARRSRMRKQRHLDELLSQVAWLRSENHQLLDKLNQVSDNNDLVIQENSSLKEENLELRQVITSMKKLGGGIHDKYSSPSSMDELDQDFSSITDDPRTHHPS

SEQ ID NO: 961 - DNA, 561 bp, Arabidopsis thaliana
  G630 DNA sequence used for BLAST
atgcagccaaattatgatagctcaagtcttaacaacatgcaacaacaagactacttcaacttgaacaactactacaacaacttaaacccttcaaccaataacaacaacctcaatatcctccaataccctcaaattcaagaactcaacctacaatctccggtaagcaacaactccacaacttccgatgacgcaactgaagaaatcttcgtcatcaacgagaggaagcaaagacgtatggtatctaacagagagtcagcaagaagatcaagaatgagaaagcaaagacacttagatgagcttctctcacaggttgcttggcttcgaagcgagaaccaccagcttttagataagcttaaccaagtctccgacaacaatgatcttgttattcaagagaactcgagtcttaaagaagaaaacttggagcttcgtcaggttatcacatccatgaagaagcttggaggaggcatacatgacaaatattcttctccgtcgtctatggatgaattggatcaagacttttcttctatcacagatgatccaagaactcatcatccatcatga

SEQ ID NO: 962 - DNA, 1553 bp, Arabidopsis thaliana
  G632 cDNA Sequence
ctttttttcattttgttctgagggggcttttgtgttgacggtggtgggaacaaaggaacatcgtatccattctgtccgggaaacacagcaatgttcatttccgacaaatctcgtcctactgatttctacaaagacgatcatcacaattcctccaccaccagcaccacacgcgatatgatgatcgatgtactcaccactaccaacgaatcagtagatctacaatctcaccaccaccacaatcaccacaatcatcatctccaccaatctcagccacaacaacagattctcctcggagaaagcagtggagaagatcacgaagttaaagcaccaaagaaacgagcggagacatgggttcaagacgaaactcgtagcttaatcatgttccgtagaggtatggatggtttattcaatacatccaaatctaataaacatctctgggaacagatttcgtctaagatgagagaaaaagggtttgatcgatctccgactatgtgtactgataaatggaggaatctgttgaaagagtttaagaaagctaagcatcatgatagaggaaatggatcggcgaagatgtcgtattacaaagagattgaagatattcttagagagaggagcaaaaaagtgacaccaccacagtataataagagccctaatacaccacctacatcagccaaagttgattcctttatgcaatttactgataaaggttttgatgatacgagcatttcttttggatccgttgaagctaatggcaggccagccttaaaccttgaaaggcgtcttgatcatgatggtcatcctcttgcaatcactacagcagttgatgctgttgcagcaaatggagttactccttggaattggagagagactcctggaaacggtgatgatagtcatggtcagccttttggtggtagggtcataacagtgaaatttggtgactatacaagaagaatcggtgttgatggtagtgcagaagcaatcaaagaggtaatcagatctgcttttgggttaagaactcgaagggctttttggttagaagatgaagatcagattattcgctgtcttgaccgagacatgcccttagggaactatctactccgtctggatgatggactggccattagggtttgccattatgatgaatccaaccaattaccagtccattcagaagagaaaatcttctacactgaagaagactaccgcgagtttctggctctacagggatggtcaagcctgcaagttgatggttttaggaacatagaaaacatggatgatcttcaacctggtgctgtgtatcgaggtgtgagatgaggaaatgagatcacaaaacttcttctccaattctatcaacagttatctgaacagaaaacagtcccctgtagatatgatctcattctctttatacatttcttctttttttcatgtacttgctcaaatatgaaatatcataactggcatttaccgtacagaccaagaagacctcaaaatagatttttggtctgttacatttgtaagaacagaacataagagaagtgaataaattgttcacaatc

SEQ ID NO: 963 - protein, 406 aa, Arabidopsis thaliana
  G632 Amino Acid Sequence
MFISDKSRPTDFYKDDHHNSSTTSTTRDMMIDVLTTTNESVDLQSHHHHNHHNHHLHQSQPQQQILLGESSGEDHEVKAPKKRAETWVQDETRSLIMFRRGMDGLFNTSKSNKHLWEQISSKMREKGFDRSPTMCTDKWRNLLKEFKKAKHHDRGNGSAKMSYYKEIEDILRERSKKVTPPQYNKSPNTPPTSAKVDSFMQFTDKGFDDTSISFGSVEANGRPALNLERRLDHDGHPLAITTAVDAVAANGVTPWNWRETPGNGDDSHGQPFGGRVITVKFGDYTRRIGVDGSAEAIKEVIRSAFGLRTRRAFWLEDEDQIIRCLDRDMPLGNYLLRLDDGLAIRVCHYDESNQLPVHSEEKIFYTEEDYREFLALQGWSSLQVDGFRNIENMDDLQPGAVYRGVR

SEQ ID NO: 964 - DNA, 2117 bp, Arabidopsis thaliana
  G632 DNA sequence used for BLAST
atgttcatttccgacaaatctcgtcctactgatttctacaaagacgatcatcacaattcctccaccaccagcaccacacgcgatatgatgatcgatgtactcaccactaccaacgaatcagtagatctacaatctcaccaccaccacaatcaccacaatcatcatctccaccaatctcagccacaacaacagattctcctcggagaaagcagtggagaagatcacgaagttaaagcaccaaagaaacgagcggagacatgggttcaagacgaaactcgtagcttaatcatgttccgtagaggtatggatggtttattcaatacatccaaatctaataaacatctctgggaacagatttcgtctaagatgagagaaaaagggtttgatcgatctccgactatgtgtactgataaatggaggaatctgttgaaagagtttaagaaagctaagcatcatgatagaggaaatggatcggcgaagatgtcgtattacaaagagattgaagatattcttagagagaggagcaaaaaagtgacaccaccacagtataataagagccctaatacaccacctacatcagccaaagttgattcctttatgcaatttactgataaaggtataaactttggcatcaattgtagatttcttgatttggattcagagaacgtaactgtgattatggtttttgttgctactatttgggaaaattcttatctgtatcttaggctgagaagatactacattttagagtaggtttcttattgtggtttttcagttatctttaaagaagatgatagttttggtaaatgaatctgcgtatgtggattttgtgcctttaattttcttttggctaagtggtaattttatctttcattgtaggttttgatgatacgagcatttcttttggatccgttgaaggtacttatctatcactattagtttgtttattatagtatcttgctatgtatacaaagagacgagcttttgtttgtctactgcctcttgaagttgtcttttaagttggtcgaaaacatctccctgagtgagcaatagtagaggtatgaacttgcttagtgaagtgaacatttgggactgaaacaaatagtaaacatgactgtgccgtagaattcacaggcagtttctgtgttagatggtttagttttgtttctagaggatgtgtgtgtgtgtgtgtatgtttgaaaagtgtatatatatctatgtttcagctaatggcaggccagccttaaaccttgaaaggcgtcttgatcatgatggtcatcctcttgcaatcactacagcagttgatgctgttgcagcaaatggagttactccttggaattggagagagactcctggaaacggcaagtcctcagaaaaagcttatataaacttaagcctcaaagtttaattttctataaggctaaagatatgttttttgaactgtatgtttatgttccaagcatggtgtaatatgtgtaagaatccacgttttctcattttgaggttgcttcacagcctctgctcctctgcttgatttattcgttcggtctctttataactgagtagagcttttcatttgtttcatgtttatacaagcaggtgatgatagtcatggtcagccttttggtggtagggtcataacagtgaaatttggtgactatacaagaagaatcggtgttgatggtagtgcagaagcaatcaaagaggtaatcagatctgcttttgggttaagaactcgaagggctttttggttagaagatgaagatcagattattcgctgtcttgaccgagacatgcccttagggaactatctactccgtctggatgatggtaagattaaatttgccactattcgtatcttttgaactgtgtgtgtgttttttactgaattgtcagtatgcaaaacccatcttgcaggactggccattagggtttgccattatgatgaatccaaccaattaccagtccattcagaagagaaaatcttctacactgaagaagactaccgcgagtttctggctcgacagggatggtcaagcctgcaagttgatggttttaggaacatagaaaacatggatgatcttcaacctggtgctgtgtatcgaggtgtgagatga

SEQ ID NO: 965 - DNA, 2166 bp, Arabidopsis thaliana
  G633 cDNA Sequence
aaaagttccccttttaagtcctactcctctttttgttatatagaaagaaaaactatatatatacaaaataaagttatacgaagaaaattgtattatatttataagatctagataaaatggtccatcccacccaattaaatacccctaagataaaatcacaatagacgaaaaaaatttaaaaagaaaagaaaaaggaaattcaaccacaaccttcgtcttctcttgaaactctcctcatctctctcaagaaagattcaagttcgagtcttagctatgtctggaaactcagaaggactgttagagagctcaggcggcggcgtgggaggttccgtcgaggaggaaaaagatatgaagatggaggaaaccggtgaaggagccggcagcggaggaaaccggtggccaagaccagagactttagctctattgagaatacgttcagagatggataaagcttttcgtgactctactctcaaagctcccttatgggaagaaatttccaggaaaatgatggagcttggttacaagagaagttcaaagaaatgcaaggagaagttcgagaacgtgtacaagtaccacaaacgtaccaaagaaggtcgtaccgggaaatccgaaggcaaaacttaccggtttttcgaagagttagaagctttcgagactctcagttcctatcaacctgaacctgagtcgcaacccgcgaaatcttctgcagtgatcacgaacgcgcccgcaacctcttccttgataccatggattagctctagcaatccatcaaccgaaaaaagttcttcaccgttgaaacatcatcatcaggttagtgtacaacccatcaccacaaaccctaccttcctcgccaagcaaccatcttccacgacgccttttcctttttatagcagcaacaatactactactgttagccagccgccaatttcaaatgacttgatgaacaatgtttcatcgctgaatcttttctcgagctcaacttcttcatctactgcatctgacgaggaagaagatcatcatcaggttaagagctcgagaaagaagaggaagtattggaaagggttgtttacgaagttgacaaaagagttaatggagaaacaagagaagatgcaaaaaaggttcttggaaacactggagtatcgtgagaaagagagaatctcaagagaagaagcttggagggtccaagagatagggagaatcaacagagaacacgaaacattaatccatgagaggtccaatgctgcagctaaagacgctgcaatcatatccttcttacacaaaatctcaggaggacaaccacaacaaccgcaacaacataatcataaaccatcacaaaggaaacaatatcaaagcgatcattcaataacgtttgagagtaaagagccgagggcggttctattggatacaacaataaagatggggaattacgataacaatcattcggtgtctcctagttcttcaagatggcctaaaaccgaggtcgaggccttgataaggataagaaagaatcttgaagctaactatcaagaaaacggtactaagggaccattatgggaagagatctctgcagggatgagaagattgggatacaatagaagcgcgaaacgctgcaaagagaagtgggaaaacatcaacaagtactttaagaaagtcaaagaaagcaacaagaaacgtccccttgattccaagacttgcccttattttcaccagctcgaagctttgtacaacgagaggaacaaaagtggggcaatgccattgccattgcctctaatggtgactccacagagacagttgcttctctcgcaagaaacccagaccgagtttgagactgatcagagggaaaaagttggtgataaagaagatgaagaagaaggagagagtgaagaagatgaatacgatgaagaagaagagggagaaggagacaatgagacaagtgagttcgagattgtgttgaacaaaacatcttcacctatggacattaacaataatcttttcacctaagtggttttataatcattttattatatacactttcctgtaaaatggggttgaaggaaaaaaaaaaaagcatatacaacaaatgtaagtaaatggcttgattttttagttattagtattccatttcgtgatatatttaataaaataattgattaaaaagaaaaaaaa

SEQ ID NO: 966 - protein, 575 aa, Arabidopsis thaliana
  G633 Amino Acid Sequence
MSGNSEGLLESSGGGVGGSVEEEKDMKMEETGEGAGSGGNRWPRPETLALLRIRSEMDKAFRDSTLKAPLWEEISRKMMELGYKRSSKKCKEKFENVYKYHKRTKEGRTGKSEGKTYRFFEELEAFETLSSYQPEPESQPAKSSAVITNAPATSSLIPWISSSNPSTEKSSSPLKHHHQVSVQPITTNPTFLAKQPSSTTPFPFYSSNNTTTVSQPPISNDLMNNVSSLNLFSSSTSSSTASDEEEDHHQVKSSRKKRKYWKGLFTKLTKELMEKQEKMQKRFLETLEYREKERISREEAWRVQEIGRINREHETLIHERSNAAAKDAAIISFLHKISGGQPQQPQQHNHKPSQRKQYQSDHSITFESKEPRAVLLDTTIKMGNYDNNHSVSPSSSRWPKTEVEALIRIRKNLEANYQENGTKGPLWEEISAGMRRLGYNRSAKRCKEKWENINKYFKKVKESNKKRPLDSKTCPYFHQLEALYNERNKSGAMPLPLPLMVTPQRQLLLSQETQTEFETDQREKVGDKEDEEEGESEEDEYDEEEEGEGDNETSEFEIVLNKTSSPMDINNNLFT

SEQ ID NO: 967 - DNA, 2415 bp, Arabidopsis thaliana
  G633 Genomic Sequence
ggtttgttttataggaaatactttaatttttggtaccaaatttttcttataagcaacgagaagattcccaaattaaaagacagaaggaaagcgaaaaaagttccccttttaagtcctactcctctttttgtaatatagaaagaaaaactatatatatacaaaataaagttatacgaagaaaattgtattatatttataagatctagataaaatggtccatcccacccaattaaatacccctaagataaaatcacaatagacaaaaaaaatttaaaaagaaaagaaaaaggaaattcaaccacaaccttcgtcttctcttgaaactctcctcatctctctcaagaaagattcaagttcgagtcttagctatgtctggaaactcagaaggactgttagagagctcaggcggcggcgtgggaggttccgtcgaggaggaaaaagatatgaagatggaggaaaccggtgaaggagccggcagcggaggaaaccggtggccaagaccagagactttagctctattgagaatacgttcagagatggataaagcttttcgtgactctactctcaaagctcccttatgggaagaaatttccaggtttgttatatttggtacatgcatatatatttataaagtagaaaatttaagcagaaattttatgatcatatattttcgtctcacatatttatgggatgtatatataatatgtgtagcatatatttcggtaattcatttgaaatatatgactacaagcctatttatttgcttataggtatatgtattacatacaactagctaagaaaaagtttggataatatttgtttcttaattatgagtttattgattgatacatgaattaggaaaatgatggagcttggttacaagagaagttcaaagaaatgcaaggagaagttcgagaacgtgtacaagtaccacaaacgtaccaaagaaggtcgtaccgggaaatccgaaggcaaaacttaccggtttttcgaagagttagaagctttcgagactctcagttcctatcaacctgaacctgagtcgcaacccgcgaaatcttctgcagtgatcacgaacgcgcccgcaacctcttccttgataccatggattagctctagcaatccatcaaccgaaaaaagttcttcaccgttgaaacatcatcatcaggttagtgtacaacccatcaccacaaaccctaccttcctcgccaagcaaccatcttccacgacgccttttcctttttatagcagcaacaatactactactgttagccagccgccaatttcaaatgacttgatgaacaatgtttcatcgctgaatcttttctcgagctcaacttcttcatctactgcatctgacgaggaagaagatcatcatcaggttaagagctcgagaaagaagaggaagtattggaaagggttgtttacgaagttgacaaaagagttaatggagaaacaagagaagatgcaaaaaaggttcttggaaacactggagtatcgtgagaaagagagaatctcaagagaagaagcttggagggtccaagagatagggagaatcaacagagaacacgaaacattaatccatgagaggtccaatgctgcagctaaagacgctgcaatcatatccttcttacacaaaatctcaggaggacaaccacaacacccgcaacaacataatcataaaccatcacaaaggaaacaatatcaaagcgatcattcaataacgtttgagagtaaagagccgagggcggttctattggatacaacaataaagatggggaattacgataacaatcattcggtgtctcctagttcttcaagatggcctaaaaccgaggtcgaggccttgataaggataagaaagaatcttgaagctaactatcaagaaaacggtactaagggaccattatgggaagagatctctgcagggatgagaagattgggatacaatagaagcgcgaaacgctgcaaagagaagtgggaaaacatcaacaagtactttaagaaagtcaaagaaagcaacaagaaacgtccccttgattccaagacttgcccttattttcaccagctcgaagctttgtacaacgagaggaacaaaagtggggcaatgccattgccattgcctctaatggtgactccacagagactgttgcttctctcgcaagaaaccctgaccgagtttgagactgatcagagggaaaaagttggtgataaagaagatgaagaagaaggagagagtgaagaagatgaatacgatgaagaagaagagggagaaggagacaatgagacaagtgagttcgagattgtgttgaacaaaacatcttcacctatggacattaacaataatcttttcacctaggtggttttataatcattttattatatacactttcctgtttaatggggttgaaggat

SEQ ID NO: 968 - DNA, 1993 bp, Arabidopsis thaliana
  G633 DNA sequence used for BLAST
ttaggtgaaaagattattgttaatgtccataggtgaagatgttttgttcaacacaatctcgaactcacttgtctcattgtctccttctccctcttcttcttcatcgtattcatcttcttcactctctccttcttcttcatcttctttatcaccaactttttccctctgatcagtctcaaactcggtctgggtttcttgcgagagaagcaactgtctctgtggagtcaccattagaggcaatggcaatggcattgccccacttttgttcctctcgttgtacaaagcttcgagctggtgaaaataagggcaagtcttggaatcaaggggacgtttcttgttgctttctttgactttcttaaagtacttgttgatgttttcccacttctctttgcagcgtttcgcgcttctattgtatcccaatcttctcatccctgcagagatctcttcccataatggtcccttagtaccgttttcttgatagttagcttcaagattctttcttatccttatcaaggcctcgacctcggttttaggccatcttgaagaactaggagacaccgaatgattgttatcgtaattccccatctttattgttgtatccaatagaaccgccctcggctctttactctcaaacgttattgaatgatcgctttgatattgtttcctttgtgatggtttatgattatgttgttgcggttgttgtggttgtcctcctgagattttgtgtaagaaggatatgattgcagcgtctttagctgcagcattggacctctcatggattaatgtttcgtgttctctgttgattctccctatctcttggaccctccaagcttcttctcttgagattctctctttctcacgatactccagtgtttccaagaaccttttttgcatcttctcttgtttctccattaactcttttgtcaacttcgtaaacaaccctttccaatacttcctcttctttctcgagctcttaacctgatgatgatcttcttcctcgtcagatgcagtagatgaagaagttgagctcgagaaaagattcagcgatgaaacattgttcatcaagtcatttgaaattggcggctggctaacagtagtagtattgttgctgctataaaaaggaaaaggcgtcgtggaagatggttgcttggcgaggaaggtagggtttgtggtgatgggttgtacactaacctgatgatgatgtttcaacggtgaagaacttttttcggttgatggattgctagagctaatccatggtatcaaggaagaggttgcgggcgcgttcgtgatcactgcagaagatttcgcgggttgcgactcaggttcaggttgataggaactgagagtctcgaaagcttctaactcttcgaaaaaccggtaagttttgccttcggatttcccggtacgaccttctttggtacgtttgtggtacttgtacacgttctcgaacttctccttgcatttctttgaacttctcttgtaaccaagctccatcattttcctaattcatgtatcaatcaataaactcataattaagaaacaaatattatccaaactttttcttagctagttgtatgtaatacatatacctataagcaaataaataggcttgtagtcatatatttcaaatgaattaccgaaatatatgactacacatattatatatacatcccataaatatgtgagacgaaaatatatgatcataaaatttctgcttaaattttctactttataaatatatatgcatgtaacaaaatataacaaacctggaaatttcttcccataagggagctttgagagtagagtcacgaaaagctttatccatctctgaacgtattctcaatagagctaaagtctctggtcttggccaccggtttcctccgctgccggctccttcaccggtttcctccatcttcatatctttttcctcctcgacggaacctcccacgccgccgcctgagctctctaacagtccttctgagtttccagacat

SEQ ID NO: 969 - DNA, 2121 bp, Arabidopsis thaliana
  G634 cDNA Sequence
ggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccacttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttcta

SEQ ID NO: 970 - protein, 669 aa, Arabidopsis thaliana
  G634 Amino Acid Sequence
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPSSSLDVTPLSVANPILMPSSSSSPFPVFSQPQPQTQTQPPQTHNVSFTPTPPPLPLPSMGPIFTGVTFSSHSSSTASGMGSDDDDDDMDVDQANIAGSSSRKRKRGNRGGGGKMMELFEGLVRQVMQKQAAMQRSFLEALEKREQERLDREEAWKRQEMARLAREHEVMSQERAASASRDAAIISLIQKITGHTIQLPPSLSSQPPPPYQPPPAVTKRVAEPPLSTAQSQSQQPIMAIPQQQILPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNKKRPQDAKTCPYFHRLDLLYRNKVLGSGGGSSTSGLPQDQKQSPVTAMKPPQEGLVNVQQTHGSASTEEEEPIEESPQGTEKPEDLVMRELIQQQQQLQQQESMIGEYEKIEESHNYNNMEEEEDQEMDEEELDEDEKSAAFEIAFQSPANRGGNGHTEPPFLTMVQ

SEQ ID NO: 971 - DNA, 2462 bp, Arabidopsis thaliana
  G634 DNA sequence used for BLAST
ttactgaaccattgtcaagaaaggtggttccgtatggccattgcctcctctgtttgcagggctttgaaacgcaatctcgaaagccgcggacttctcatcctcgtctagttcttcctcatccatttcctgatcttcctcttcctccatgttattataattgtgagactcttcaatcttttcatactcacctatcattgattcttgttgttgtagttgctgttgttgttgaatcagctctctcatcacaaggtcttctggcttcaattccaacaaatcatatttcagttatcaaagaacattaaaccaatcacattttgacaaggaaaagcaaagtttgtaccttttctgttccttgtggactttcctctataggctcttcttcctcagttgaagctgacccatgagtttgttgaacattaacaagtccttcttgtggcggtttcatcgcagtgaccggactctgtttttggtcttgaggtagaccagaagtgctagaaccaccgccactaccgagtactttgttgcggtaaagaagatcgaggcggtgaaagtaaggacaagtcttagcatcttgaggacgtttcttgttgctttctttaactttcttgtagtatttgtttatgttttcccatttctctttacatctcttagcgtttctgttgtatcccattctcttcattgaagttgagatctcttcccatagaagtcctttaggtacattatcttggtaccttggttccattccacttctcaggtttataagcgctagaatctctgcctttggccatcttgatgatgatggtaatgatgattgttccgagctcatgaccatctcttgttgtggttgttgttgttgtttctgttctggttgatgagcgtgaggatgagaaggaggaggaggaggaagaatttgttgttgtggaatcgccattattggttgttgtgattgagattgagctgttgataatggtggttccgccacacgtttagtgaccgcgggtggcggttgatacggtggaggcggttgagatgacaaagaaggaggtaactgaatggtatggccagtaattttctgaatcaatgaaatgattgcggcgtcacgagaagcagaggcggctcgttcttgagacatgacctcgtgttctcgagctaaccgagccatttcttgacgtttccaagcttcttcacgatcaagacgttcttgctctctcttctcaagagcttccaagaaactcctttgcatagccgcttgcttttgcattacttgtctcaccaaaccttcaaacaattccatcattttaccgcctccaccgcggtttccacgtttgcgttttcggctactagaacccgcaatgttagcctgatcaacgtccatatcgtcgtcatcatcatcagaccccattcctgaagccgtcgatgagctatgagacgagaaagtaacaccggtaaatatcggacccattgaaggaagtggaagaggtggtggagtaggagtaaaagagacattatgcgtttgaggcggttgcgtttgcgtttgcggttgcggttgagagaatacgggaaatggagaagaagaagaagaaggcatgagaatgggattagcgacggagagaggagtaacgtcgagggaagatgaaggaggagtagtgttgagagcttcaagctgagagaagaacttgtaagctttaccatcatgacgaccaccgcgagtttctttagtacgtttgtaatatttctgaacgttttcgaatttctctttgcatttctttgaacttcgtttgtaacctaactccaatagcttcctgtttccaaaaacatgaaaataattcagattctctagttttattttatttttggttgtcgttattagctggaaaatttttatggttactgttcgatcggattttttttttttttttttggaagtaaagagagtcttgggattttcaaaatcgaaaacgtcccagaaactcatgaaccaacttctgtaataaacaaacagttcttttaatttttcttggggatggtgaagatgctttgatctcgaatatattactatttatatatacctaacactaaaaaaaaaaagttaacaaaaaaaaaacacatgcaaatggatctctatcaagaaacaccattgatgaaaatggaagagaagagaggaagagagacctggaaacatgttcccaaagaggagctttgagagtagcatcacgaaaagtagaatccatatcggatcggatccgaagaagagctaaagtttcttctctcggccatcgatttcccgatgaagaagaagcacttcctcctcctcctcctccacctccacctcctaatccaccgtcatccgcggcggctgagaatctcataagctcttctaagttgttagcaggaggtcttgaactaataggtgaagcttcctccacaacttcattaccaccaccacctcctccttgctccat

SEQ ID NO: 972 - DNA, 1968 bp, Arabidopsis thaliana
  G640 cDNA Sequence
aaaagaaaatgtttgatggtggagtacctgagcagatccaccgtttcatagcttctccaccgccaccgcctccgcttccgccgcatcaaccggcggcggaaagatcactaccttttcctgtctcattctcttcctttaacaccaatcatcaacctcagcatatgttgagcttggatagccgtaagatcattcaccatcatcatcatcatcatcaccatgacatcaaagatggtggtgctactactggtgagtggataggtcagacggatcatgatgatagcgataatcatcatcaacatcatcatcatcatccatggtgtagtgatgaagttcttgctcttcttaggttcagatctacagtggagaattggttccctgaattcacttgggagcatacttcaagaaagttggcagaagttggttttaagaggagtccacaagaatgcaaagagaaatttgaagaagaagagagaagatatttcaatagcaacaacaacaacaacaacaacactaatgatcatcaacacatcggcaattataacaacaagggaaataattataggatatttagtgaggttgaagagttttatcatcatggtcatgacaatgaacatgtttcatcagaagttggggataaccaaaacaagaggaccaatttagtagaaggaaaaggaaacgtgggagaaacggtacaagacttaatggcggaggacaaattaagagatcaggatcagggtcaagtagaagaagcatcaatggagaatcaaagaaactctattgaggttggaaaagttggaaacgtagaagatgatgccaagtcatcatcatcatcaagcttgatgatgatcatgaaggagaagaagaggaagaagaggaagaaagagaaagagaggtttggtgtgttaaaagggttttgtgagggtctagtgaggaacatgatagctcaacaagaggagatgcataagaaactcctggaagatatggtgaagaaggaagaagagaagatagcgagagaggaagcttggaagaagcaagagattgagagagttaacaaagaggtagagattagagcacaagaacaagccatggctagtgatagaaacaccaacatcatcaagttcatatccaagtttacagaccatgatcttgatgttgtccaaaacccaacaagcccttctcaagactcatcttctttagctctacgaaaaacccaaggcagaagaaagtttcaaacttcatcatcactattacctcaaaccctaactccacataaccttttaaccattgacaaatcacttgaacctttttctactaaaaccctaaaacccaaaaaccaaaacccaaaacctccaaaaagcgatgataaaagtgatcttggcaagagatggccaaaggatgaagtgttggctctgatcaacattagaagaagtatcagtaacatgaatgatgatgatcataaagatgagaactcattatcaacatcttcaaaagctgttccattatgggaaagaatatccaagaaaatgttggagattgggtacaagagaagtgccaaaagatgcaaagagaaatgggaaaacatcaacaagtattttaggaagacaaaagatgttaacaagaagagaccacttgactcaaggacttgtccttattttcaccaactcacagctttatacagccaaccaccaacagggaccaccgccaccaccgccaccacggccacgtcagccagagatctagacacccgacccgaggaaaaccgggttggatcccaagatcctgatatttctgtacccatgcatgtagatggagatggtgctggcgataaaagcaatgttcagttttcaggtttcgatcttgagttctaataaatcccttctatatatatattatcagttatattctctttttctgctttttgctaaaacctcatttttggttattatgataaagttattatatatgaat

SEQ ID NO: 973 - protein, 619 aa, Arabidopsis thaliana
  G640 Amino Acid Sequence
MFDGGVPEQIHRFIASPPPPPPLPPHQPAAERSLPFPVSFSSFNTNHQPQHMLSLDSRKIIHHHHHHHHHDIKDGGATTGEWIGQTDHDDSDNHHQHHHHHPWCSDEVLALLRFRSTVENWFPEFTWEHTSRKLAEVGFKRSPQECKEKFEEEERRYFNSNNNNNNNTNDHQHIGNYNNKGNNYRIFSEVEEFYHHGHDNEHVSSEVGDNQNKRTNLVEGKGNVGETVQDLMAEDKLRDQDQGQVEEASMENQRNSIEVGKVGNVEDDAKSSSSSSLMMIMKEKKRKKRKKEKERFGVLKGFCEGLVRNMIAQQEEMHKKLLEDMVKKEEEKIAREEAWKKQEIERVNKEVEIRAQEQAMASDRNTNIIKFISKFTDHDLDVVQNPTSPSQDSSSLALRKTQGRRKFQTSSSLLPQTLTPHNLLTIDKSLEPFSTKTLKPKNQNPKPPKSDDKSDLGKRWPKDEVLALINIRRSISNMNDDDHKDENSLSTSSKAVPLWERISKKMLEIGYKRSAKRCKEKWENINKYFRKTKDVNKKRPLDSRTCPYFHQLTALYSQPPTGTTATTATTATSARDLDTRPEENRVGSQDPDISVPMHVDGDGAGDKSNVQFSGFDLEF

SEQ ID NO: 974 - DNA, 2313 bp, Arabidopsis thaliana
  G640 DNA sequence used for BLAST
ttagaactcaagatcgaaacctgaaaactgaacattgcttttatcgccagcaccatctccatctacatgcatgggtacagaaatatcaggatcttgggatccaacccggttttcctcgggtcgggtgtctagatctctggctgacgtggccgtggtggcggtggtggcggtggtccctgttggtggttggctgtataaagctgtgagttggtgaaaataaggacaagtccttgagtcaagtggtctcttcttgttaacatcttttgtcttcctaaaatacttgttgatgttttcccatttctctttgcatcttttggcacttctcttgtacccaatctccaacattttcttggatattctttcccataatggaacagcttttgaagatgttgataatgagttctcatctttatgatcatcatcattcatgttactgatacttcttctaatgttgatcagagccaacacttcatcctttggccatctcttgccaagatcacttttatcatcgctttttggaggttttgggttttggtttttgggttttagggttttagtagaaaaaggttcaagtgatttgtcaatggttaaaaggttatgtggagttagggtttgaggtaatagtgatgatgaagtttgaaactttcttctgccttgggtttttcgtagagctaaagaagatgagtcttgagaagggcttgttgggttttggacaacatcaagatcatggtctgtaaacttggatatgaacttgatgatgttggtgtttctatcactagccatggcttgttcttgtgctctaatctctacctctttgttaactctctcaatctcttgcttcttccaagcttcctctctcgctatcttctcttcttccttcttcaccatatcttccaggagtttcttatgcatctcctcttgttgagctatcatgttcctcactagaccctcacaaaacccttttaacacaccaaacctctctttctctttcttcctcttcttcctcttcttctccttcatgatcatcatcaagcttgatgatgatgatgacttggcatcatcttctacgtttccaacttttccaacctcaatagagtttctttgattctccattgatgcttcttctacttgaccctgatcctgatctcttaatttgtcctccgccattaagtcttgtaccgtttctcccacgtttccttttccttctactaaattggtcctcttgttttggttatccccaacttctgatgaaacatgttcattgtcatgaccatgatgataaaactcttcaacctcactaaatatcctataattatttcccttgttgttataattgccgatgtgttgatgatcattagtgttgttgttgttgttgttgttgctattgaaatatcttctctcttcttcttcaaatttctctttgcattcttgtggactcctcttaaaaccaacttctgccaactttctacaacatcataatttcataaacgacataacgtcattaataatacgaatatacatatatatatatatacgaatatacatatatatatatatacacacttctaccaataatatacacatatatgtattgatatcttacaatttcatcgttagtttatttttaaaaatgcattaaaatggcacaaaaatgtcaattatgtataaatataaatagttattaatggccaatcatttgttaacatcaaaattaaatatcccaaaaaatgcttattcaaaagaaaaagatctctagtctatcaaatcaaattgagtaacatgataattgtaattgttgtaaatgtactcttataaaataaatactaatgttcatgtccatatgcatatgaagaaaaatataaatgtgttgatgcatatataaagaagtatatttatatatgtgtgtgatatgtattaccttgaagtatgctcccaagtgaattcagggaaccaattctccactgtagatctgaacctaagaagagcaagaacttcatcactacaccatggatgatgatgatgatgttgatgatgattatcgctatcatcatgatccgtctgacctatccactcaccagtagtagcaccaccatctttgatgtcatggtgatgatgatgatgatgatggtgaatgatcttacggctatccaagctcaacatatgctgaggttgatgattggtgttaaaggaagagaatgagacaggaaaaggtagtgatctttccgccgccggttgatgcggcggaagcggaggcggtggcggtggagaagctatgaaacggtggatctgctcaggtactccaccatcaaacat

SEQ ID NO: 975 - DNA, 1083 bp, Arabidopsis thaliana
  G641 cDNA Sequence
tcttgattctttcatatggatggacatcagcatcatcaccttcaccagcttcaatatctcaacaagcatcatcttcatactcaatcgcaaacgccggaaatagcctctccggtagctgttggggataggtttccacagtggagcgtcgaagagacaaaagagttgatagggataagaggagagctagatcaaactttcatggagacaaaacggaacaagcttctttgggaagttatctctaacaagatgagagacaaaagctttcctcgtagccctgaacagtgcaagtgcaagtggaagaacctcgtcactcgttttaagggatgtgagacaatggaggcagagacagcgagacaacagttccctttttatgatgatatgcaaaatatatttaccactagaatgcagagaatgctatgggctgaatccgagggaggaggagggggaacaagcggggcagcgagaaagagagagtattcttcagatgaggaagaagagaatgtgaatgaagagctagtagatgtcagcaacgacccaaaaattctaaatccgaaaaagaacattgcaaagaagcgaaaaggcggtagtaatagtagtaatagcaataatggtgtaagagaagtgttggaagagtttatgagacatcaagtgagaatggagagcgagtggagagaaggatgggaggctagggagaaggaaagagcagagaaagaagaagaatggagaaggaagatggaggagcttgagaaggagaggttggcaatggagcggatgtggcgggatagagaggagcaacggcggtcgagggaggagatgagagcagagaagagggattcacttatcaatgcattgcttgctaagcttactagagatggttccctctaatcttttgtcagctttgcttaacctaaattaacttgttcttatatgcttgtttggggtgtagtgtaggtacaattatttggtgggggaagataatatctacggcaaatctcaacactcatatattgattgatatgatgacatatttgagttttagtgaggctttagtaatttatcatccccacatttttcttcctagtt

SEQ ID NO: 976 - protein, 289 aa, Arabidopsis thaliana
  G641 Amino Acid Sequence
MDGHQHHHLHQLQYLNKHHLHTQSQTPEIASPVAVGDRFPQWSVEETKELIGIRGELDQTFMETKRNKLLWEVISNKMRDKSFPRSPEQCKCKWKNLVTRFKGCETMEAETARQQFPFYDDMQNIFTTRMQRMLWAESEGGGGGTSGAARKREYSSDEEEENVNEELVDVSNDPKILNPKKNIAKKRKGGSNSSNSNNGVREVLEEFMRHQVRMESEWREGWEAREKERAEKEEEWRRKMEELEKERLAMERMWRDREEQRRSREEMRAEKRDSLINALLAKLTRDGSL

SEQ ID NO: 977 - DNA, 1117 bp, Arabidopsis thaliana
  G641 Genomic Sequence
atggatggacatcagcatcatcaccttcaccagcttcaatatctcaacaagcatcatcttcatactcaatcgcaaacgccggaaatagcctctccggtagctgttggggataggtttccacagtggagcgtcgaagagacaaaagagttgatagggataagaggagagctagatcaaactttcatggagacaaaacggaacaagcttctttgggaagttatctctaacaagatgagagacaaaagctttcctcgtagccctgaacagtgcaagtgcaagtggaagaacctcgtcactcgttttaaggtctattctctctctccctcttctttcattttgtggatgttttataatcttggaggtcttgcatggaacaaataaataaataaaaatttgtaaccaagaaatattgaatcttatagtccataatctttccgggacatatagacaaacaccattgtaaatatttctgaatcttgttgtccataatctgctaagtagtttaattatatgtatacaatctcattggtgatgtattgcttgatgtttctagggatgtgagacaatggaggcagagacagcgagacaacagttccctttttatgatgatatgcaaaatatatttaccactagaatgcagagaatgctatgggctgaatccgagggaggaggagggggaacaagcggggcagcgagaaagagagagtattcttcagatgaggaagaagagaatgtgaatgaagagctagtagatgtcagcaacgacccaaaaattctaaatccgaaaaagaacattgcaaagaagcgaaaaggcggtagtaatagtagtaatagcaataatggtgtaagagaagtgttggaagagtttatgagacatcaagtgagaatggagagcgagtggagagaaggatgggaggctagggagaaggaaagagcagagaaagaagaagaatggagaaggaagatggaggagcttgagaaggagaggttggcaatggagcggatgtggcgggatagagaggagcaacggcggtcgagggaggagatgagagcagagaagagggattcacttatcaatgcattgcttgctaagcttactagagatggttccctctaa

SEQ ID NO: 978 - DNA, 1117 bp, Arabidopsis thaliana; identical to SEQ ID NO: 977
  G641 DNA sequence used for BLAST

SEQ ID NO: 979 - DNA, 1191 bp, Arabidopsis thaliana
  G642 cDNA Sequence
ccacgcgtccgcgggatgtcctcaccataacgccgttaagtctggaacccgtttgaacggaattatcaaaacgggaaggaatattccgtttgaatggctctggaacagttaggattaggagtgagcgccgttgacggtggagagaacagtagcgcgccgtcaaatgacggtggagatgacggcgttaagacggcgagacttcctcgttggacgagacaagagattctggttctgattcaagggaagagagtggcggagaacagagtccggcgagggagagcggcgggtatggctctcgggtcgggtcaaatggagcctaaatgggcttctgtttcgtcttactgtaaacgtcacggtgtaaatcgtgggccggttcagtgccggaaaagatggagcaatctcgccggagattataagaagattaaagaatgggagtctcagattaaggaagagactgagtcctattgggttatgaggaatgatgttcgtagagagaagaagcttcctggttttttcgataaggaggtttatgatattgttgacggtggtgtgattcctccggcggttccggttctttcgcttggattggctccggcgtcagacgagggattgttgtctgatttagatcggagagaaagtcctgagaagttgaattctactccggtggctaaatcagttactgatgttatagacaaagagaagcaagaagcttgtgtagcagatcaaggtagagtgaaagagaaacagccagaagcagcaaacgtggaaggtggatcgacatcacaagaagagaggaagcgtaaacggacatcttttggtgaaaaggaagaggaagaagaagaaggagaaacaaagaagatgcagaatcagttgatagagatactagaaagaaacgggcagttgttggcggcacagcttgaggttcagaatttaaacttaaaactagacagagagcaaagaaaagatcacggtgatagcttagtcgctgttctcaataagctcgctgatgctgtggcaaaaatcgcggataagatgtagatttagtaaaagttagttgtatatcactttggccattacttctcattcttcttcttccttttttttcaatcatttatcaccattgttgattgaatattgatgccaccacaagaggttattatacacatcttatataaaccatgagatttatac

SEQ ID NO: 980 - protein, 314 aa, Arabidopsis thaliana
  G642 Amino Acid Sequence
MALEQLGLGVSAVDGGENSSAPSNDGGDDGVKTARLPRWTRQEILVLIQGKRVAENRVRRGRAAGMALGSGQMEPKWASVSSYCKRHGVNRGPVQCRKRWSNLAGDYKKIKEWESQIKEETESYWVMRNDVRREKKLPGFFDKEVYDIVDGGVIPPAVPVLSLGLAPASDEGLLSDLDRRESPEKLNSTPVAKSVTDVIDKEKQEACVADQGRVKEKQPEAANVEGGSTSQEERKRKRTSFGEKEEEEEEGETKKMQNQLIEILERNGQLLAAQLEVQNLNLKLDREQRKDHGDSLVAVLNKLADAVAKIADKM

SEQ ID NO: 981 - DNA, 1308 bp, Arabidopsis thaliana
  G642 Genomic Sequence
ctacatcttatccgcgatttttgccacagcatcagcgagcttattgagaacagcgactaagctatcaccgtgatcttttctttgctctctgtctagttttaagtttaaattctgaacctcaagctgtgccgccaacaactgcccgtttctttctagtatctctatcaactgattctgcatcttctttgtttctccttcttcttcttcctcttccttttcaccaaaagatgtccgtttacgcttcctctcttcttgtgatgtcgatccaccttccacgtttgctgcttctggctgtttctctttcactctaccttcaagttcaaactcaacattttagtataaaaacaagaacatagagacccttcaacataaacgaaaagatcacacaccatagggaagattgttaaactacttttataacacaatttgagatgcattttagaatacgaaaacatcatttatctacatgacaacataactacatagtcaagactcaagagaaacacactctagagctctaaaactagtttgagattagcatatagagcaatagatcaagcaaatacacacagagagataaacaaaccttgatctgctacacaagcttcttgcttctctttgtctataacatcttcatcaaaaaaattgaacttcataagaaatggaatcattctgatgaacatacaaaataaaaacttaaactttgatctgaattttaccagtaactgatttagccaccggagtagaattcaacttctcaggactttctctccgatctaaatcagacaacaatccctcgtctgacgccggagccaatccaagcgaaagaaccggaaccgccggaggaatcacaccaccgtcaacaatatcataaacctccttatcgaaaaaaccaggaagcttcttctctctacgaacatcattcctcataacccaataggactcagtctcttccttaatctgagactcccattctttaatcttcttataatctccggcgagattgctccatcttttccggcactgaaccggcccacgatttacaccgtgacgtttacagtaagacgaaacagaagcccatttaggctccatttgacccgacccgagagccatacccgccgctctccctcgccggactctgttctccgccactctcttcccttgaatcagaaccagaatctcttgtctcgtccaacgaggaagtctcgccgtcttaacgccgtcatctccaccgtcatttgacggcgcgctactgttctctccaccgtcaacggcgctcactcctaatcctaactgttccagagccat

SEQ ID NO: 982 - DNA, 1308 bp, Arabidopsis thaliana; identical to SEQ ID NO: 981
  G642 DNA sequence used for BLAST

SEQ ID NO: 983 - DNA, 855 bp, Arabidopsis thaliana
  G649 cDNA Sequence
atgaactccaacgaccaggatccgattccgttcagacccgaagacaacaacttctccggttccaaaacctacgccatgagcggcaaaatcatgctaagtgcaatagtaatcctcttcttcgtcgtcattttaatggtcttcctccatctttacgctcgttggtatctcctccgtgctcgtagacgtcatctccgtcgtcgtagccgtaaccgtcgcgctacgatggttttcttcaccgctgatcctttcaccgccgcaacttccgtcgtcgcttcacgtggacttgatccaaacgttattaaatctcttcctgttttcactttctccgacgagactcataaagatccgatcgaatgcgccgtttgtttatcggaattcgaagagagcgagacgggtcgggttttgcccaattgtcaacatacttttcatgttgattgtattgatatgtggtttcattctcattccacttgtcctctttgtcgatctctcgttgagtctctcgccgggattgaatcaacggaaccgagttctagctctggattgacggatgaaccacatggatctggatcttctcagatgctgagggaagattccgggagaaaaccggcggcgattgaggttccgaggaggacttttagcgagtttgaagatgagttgactcggagagactcgccggcgagtcagtcgtttaggtctccgatgagtcggatgttatctttcactcggatgttgagtagagatagaagaagcgcttcgtctcctatcgccggagctccgccgctatcgccgacgttaagctgccggatacagatgaccgagtcagatatcgaacggggaggagaagagggtaggtga

SEQ ID NO: 984 - protein, 284 aa, Arabidopsis thaliana
  G649 Amino Acid Sequence
MNSNDQDPIPFRPEDNNFSGSKTYAMSGKIMLSAIVILFFVVILMVFLHLYARWYLLRARRRHLRRRSRNRRATMVFFTADPFTAATSVVASRGLDPNVIKSLPVFTFSDETHKDPIECAVCLSEFEESETGRVLPNCQHTFHVDCIDMWFHSHSTCPLCRSLVESLAGIESTEPSSSSGLTDEPHGSGSSQMLREDSGRKPAAIEVPRRTFSEFEDELTRRDSPASQSFRSPMSRMLSFTRMLSRDRRSASSPIAGAPPLSPTLSCRIQMTESDIERGGEEGR

SEQ ID NO: 985 - DNA, 915 bp, Arabidopsis thaliana
  G649 Genomic Sequence
atgaactccaacgaccaggatccgattccgttcagacccgaagacaacaacttctccggttccaaaacctacgccatgagcggcaaaatcatgctaagtgcaatagtaatcctcttcttcgtcgtcattttaatggtcttcctccatctttacgctcgttggtatctcctccgtgctcgtagacgtcatctccgtcgtcgtagccgtaaccgtcgcgctacgatggttttcttcaccgctgatccttccaccgccgcaacttccgtcgtcgcttcacgtggacttgatccaaacgttattaaatctcttcctgttttcactttctccgacgagactcataaagatccgatcgaatgcgccgtttgtttatcggaattcgaagagagcgagacgggtcgggttttgcccaattgtcaacatacttttcatgttgattgtattgatatgtggtttcattctcattccacttgtcctctttgtcgatctctcgttgagtctctcgccgggattgaatcaacggcggcggcgagggagagggaagttgtgattgcggttgattctgatccggttttggtaattgaaccgagttctagctctggattgacggatgaaccacatggatctggatcttctcagatgctgagggaagattccgggagaaaaccggcggcgattgaggttccgaggaggacttttagcgagtttgaagatgagttgactcggagagactcgccggcgagtcagtcgtttaggtctccgatgagtcggatgttatctttcactcggatgttgagtagagatagaagaagcgcttcgtctcctatcgccggagctccgccgctatcgccgacgttaagctgccggatacagatgaccgagtcagatatcgaacggggaggagaagagagtaggtga

SEQ ID NO: 986 - DNA, 955 bp, Arabidopsis thaliana
  G649 DNA sequence used for BLAST
atgaactccaacgaccaggatccgattccgttcagacccgaagacaacaacttctccggttccaaaacctacgccatgagcggcaaaatcatgctaagtgcaatagtaatcctcttcttcgtcgtcattttaatggtcttcctccatctttacgctcgttggtatctcctccgtgctcgtagacgtcatctccgtcgtcgtagccgtaaccgtcgcgctacgatggttttcttcaccgctgatcctttcaccgccgcaacttccgtcgtcgcttcacgtggacttgatccaaacgttattaaatctcttcctgttttcactttctccgacgagactcataaagatccgatcgaatgcgccgtttgtttatcggaattcgaagagagcgagacgggtcgggttttgcccaattgtcaacatacttttcatgttgattgtattgatatgtggtttcattctcattccacttgtcctctttgtcgatctctcgttgagtctctcgccgggattgaatcaacggcggcggcgagggagagggaagttgtgattgcggttgattctgatccggttttggtaattgaaccgagttctagctctggattgacggatgaaccacatggatctggatcttctcagatgctgagggaagattccgggagaaaaccggcggcgattgaggttccgaggaggacttttagcgagtttgaagatgagttgactcggagagactcgccggcgagtcagtcgtttaggtctccgatgagtcggatgttatctttcactcggatgttgagtagagatagaagaagcgcttcgtctcctatcgccggagctccgccgtatcgccgacgttaagctgccggatacagatgaccgagtcagatatcgaacggggaggagaagagggtaggtgacttgtcacgggttggtgtctgattggtttaatgttaaccgg

SEQ ID NO: 987 - DNA, 928 bp, Arabidopsis thaliana
  G653 cDNA Sequence
tcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgtgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgaaaaaaaaaaaaaaaaa

SEQ ID NO: 988 - protein, 200 aa, Arabidopsis thaliana
  G653 Amino Acid Sequence
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 989 - DNA, 1132 bp, Arabidopsis thaliana
  G653 Genomic Sequence
atgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaagtcagttttcctcttttgcctttcctaaatgtagttattagtgttttgagagtttcatttagatatttagctagagagatacttgatctgaattggtcttcgttaaagtgataaagttaaaacgtgttgatggtttctgaacagctgagcaattattcatcaatggaaggagtggtgtattgtaggcctcattttgagcagcttttcaaggagtctggtagtttcagcaagaactttcagtcacgtatgtaaaactcttttcttcaccttctggtccagcttttacatgtggtcactttaattttaatcttcaaactttttttttcctttcacagctgcaaagccattgactgataagccaaccccggagctggtaaacgcttcttaacaacgatgtttttatttagttacacgacttgagatacatgactctatttctcttcttggttgttctcagaataggacacctagtcgacttgctggtatgttctctggaacgcaagacaaatgcgctacttgcactaaaaccgtgtatcctatcgaaaaggttagtatacatttaagcttgtatatgtcattaccattgctttccaatacacttttgtgttctctctgtgattgttgtcaagaaaatcacagttaaacttatttggatcatttgcaatatgagttacatggatccgaatcacataaagttgagatctctttaatacagtcaattcttatatctcattgttctgttttctaaaaattgtaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgcgctactgctgctgctaccgcagctgctgcagctgtagcagccgttcccgaatcttga

SEQ ID NO: 990 - DNA, 1132 bp, Arabidopsis thaliana; identical to SEQ ID NO: 989
  G653 DNA sequence used for BLAST

SEQ ID NO: 991 - DNA, 861 bp, Arabidopsis thaliana
  G654 cDNA Sequence
gtgacagggtttagctcaaggagagggtgagaaaaagaagaagaaggtgagaaaagtgaaggcaaggctttgaggatgtcttttacaggaactcaacagaaatgcaaggcttgtgagaagactgtttatgctgttgagcttctctctgctgatggagttggatatcacaagtcttgcttcaaatgcactcactgcaaaagcaggcttcagctgagtagttactcatcaatggaaggtgttttgtactgtaagcctcattttgagcagctctttaaggagagtggtagtttcaacaagaactttcagtcacctgcaaaatcggctgacaaatcaactcctgagctgacaaggacgcctagccgagttgctggcaggttctctggtacacaagagaaatgcgccacttgtagtaaaactgtgtatcctattgaaaaggtaacagtcgagagccagacatatcacaagtcctgcttcaagtgctcacatggaggttgcccaatttcaccttccaactacgcagctcttgaaggaatcctgtactgcaagcaccatttcgctcagctcttaaggagaagggaagttacaaccacttaatcaaatccgcttccatcaaacgcttcgcagccgcagcagtcgccgccggtgtaccagcagcctccgttcctgaatcttaaaatccaataatttctcctctctagtctaaaatttgaagttaatgccaaactgattcagtttgattctctttgtgagagcgtgtgtgtaatctatgcttgatgttcttatttccattgatgtctcctaaaaatctatgtttgtgtggtgtttggttatctataaaaagtctgaaactttccttataaa

SEQ ID NO: 992 - protein, 172 aa, Arabidopsis thaliana
  G654 Amino Acid Sequence
MSFTGTQQKCKACEKTVYAVELLSADGVGYHKSCFKCTHCKSRLQLSSYSSMEGVLYCKPHFEQLFKESGSFNKNFQSPAKSADKSTPELTRTPSRVAGRFSGTQEKCATCSKTVYPIEKVTVESQTYHKSCFKCSHGGCPISPSNYAALEGILYCKHHFAQLLRRREVTTT

SEQ ID NO: 993 - DNA, 1317 bp, Arabidopsis thaliana
  G654 DNA sequence used for BLAST
atgtcttttacaggaactcaacagaaatgcaaggcttgtgagaagactgtttatgctgttgagcttctctctgctgatggagttggatatcacaagtcttgcttcaaatgcactcactgcaaaagcaggcttcaggtctgattctctcatctttgtattcatgttaacgatgctgctttaattagaggaatgagtttacgaattacccatcttcttgcttaaatgatgaattgaatgtctattgtaaccataagcagctcttgataaagtaaatgtctttttacagctgagtagttactcatcaatggaaggtgttttgtactgtaagcctcattttgagcagctctttaaggagagtggtagtttcaacaagaactttcagtcacgtatgtagttttgtttctgcttcgattcatgttttttttccgcttgcccttcttttggttattgatttaatcagtcttgcaactttgtttcctcacagctgcaaaatcggctgacaaatcaactcctgagctggtaaatgtttcttttctggtttggtcagatgctctttggatacattttctgattgaacttttctcttatatttccttcttggtttgttttcagacaaggacgcctagccgagttgctggcaggttctctggtacacaagagaaatgcgccacttgtagtaaaactgtgtatcctattgaaaaggttataactcgtttaatctttcattgctcttccttcactcatgcattttccattaactgaagctttggaatcacctttctgcactctaaggtctatgttggagtattactctaaaacacagttccatcatttgcaagaattctcctgtgttttctatttcatgttgaggatagatacataatcccctcagttaccgagaacttgcaaggaaaccaaatgttttgcacagatgcatagaccctggagatatcggttcttgttactttaatttgcatgttaaacctataaaggagacttaatatgaaaactctttatgggatttttaaaagctatttggtcacaaatatccgtctttttcgattctgaaatatgcaggtaacagtcgagagccagacatatcacaagtcctgcttcaagtgctcacatggaggttgcccaatttcaccttccaactacgcagctcttgaaggaatcctgtactgcaagcaccatttcgctcagctcttcaaggagaagggaagttacaaccacttaatcaaatccgcttccatcaaacgctctgcagccgcagcagtcgccgccggtgtaccagcagcctccgttcctgaatcttaa

SEQ ID NO: 994 - DNA, 888 bp, Arabidopsis thaliana
  G656 cDNA Sequence
atggtgaggacaccatgttgcaaagaagaaggaataaagaaaggagcttggactcctgaggaagatcaaaagcttattgcttatcttcacctacatggtgaaggtggatggcgtactctccctgaaaaagctggattgaagagatgtggaaagagttgtagattgagatgggctaattacttaagacccgacattaagagaggagagtttagtcctgaagaagacgacactatcatcaagcttcatgctcttaagggtaacaagtgggccgcaatcgccactagcttggcgggacgaactgacaacgaaataaaaaactattggaacacaaatctcaagaagcggttgaagcaaaaaggcatcgatgcaatcactcacaaaccgatcaattcaaccggtcaaaccggtttcgaaccaaaagtaaataaaccggtatattcatccggttccgctaggcttcttaaccgcgtcgcaagcaaatacgcggttgaattaaaccgggacttactgaccgggatcatcagtggaaactccaccgtcgccgaagattcacaaaactccggcgacgttgattctccgacctccacattgctcaacaaaatggcggcaacatcagttttgatcaacactacgactacatattccggcttctccgacaactgttctttcactgatgaattcaacgaattctttaacaatgaagagatctccgatatttacacgactgtcgataattttgggtttatggaagagttaaagagtattttaagctacggcgatgccagcgccggagttattgaaaattcgccggaggtcaatgtagctgatgcaatggagttcattgattcctggaacgaagatgacaatatggttggagtctttgtctga

SEQ ID NO: 995 - protein, 295 aa, Arabidopsis thaliana
  G656 Amino Acid Sequence
MVRTPCCKEEGIKKGAWTPEEDQKLIAYLHLHGEGGWRTLPEKAGLKRCGKSCRLRWANYLRPDIKRGEFSPEEDDTIIKLHALKGNKWAAIATSLAGRTDNEIKNYWNTNLKKRLKQKGIDAITHKPINSTGQTGFEPKVNKPVYSSGSARLLNRVASKYAVELNRDLLTGIISGNSTVAEDSQNSGDVDSPTSTLLNKMAATSVLINTTTTYSGFSDNCSFTDEFNEFFNNEEISDIYTTVDNFGFMEELKSILSYGDASAGVIENSPEVNVADAMEFIDSWNEDDNMVGVFV

SEQ ID NO: 996 - DNA, 1192 bp, Arabidopsis thaliana
  G656 Genomic Sequence
atggtgaggacaccatgttgcaaagaagaaggaataaagaaaggagcttggactcctgaggaagatcaaaagcttattgcttatcttcacctacatggtgaaggtggatggcgtactctccctgaaaaagctggtatatatttttttttgtcatatataggtttaaatattagctactttttaattaaaagaaattattgttatagtgtgtgtaaatgtatataggattgaagagatgtggaaagagttgtagattgagatgggctaattacttaagacccgacattaagagaggagagtttagtcctgaagaagacgacactatcatcaagcttcatgctcttaagggtaacaagtaagtatctctttttttctttctttcttaattcagtttggattagataatcattactatatgtgtaatgttgcatgaaaatactttacttttcatctcaaatgccaaccataactttttaaatcttttttgataaagattccaaatcttcattagaataaaataatatttgttagtattattttattgatagttgtgtttgattattgaaggtgggccgcaatcgccactagcttggcgggacgaactgacaacgaaataaaaaactattggaacacaaatctcaagaagcggttgaagcaaaaaggcatcgatgcaatcactcacaaaccgatcaattcaaccggtcaaaccggtttcgaaccaaaagtaaataaaccggtatattcatccggttccgctaggcttcttaaccgcgtcgcaagcaaatacgcggttgaattaaaccgggacttactgaccgggatcatcagtggaaactccaccgtcgccgaagattcacaaaactccggcgacgttgattctccgacctccacattgctcaacaaaatggcggcaacatcagttttgatcaacactacgactacatattccggcttctccgacaactgttctttcactgatgaattcaacgaattctttaacaatgaagagatctccgatatttacacgactgtcgataattttgggtttatggaagagttaaagagtattttaagctacggcgatgccagcgccggagttattgaaaattcgccggaggtcaatgtagctgatgcaatggagttcattgattcctggaacgaagatgacaatatggttggagtctttgtctga

SEQ ID NO: 997 - DNA, 1192 bp, Arabidopsis thaliana; identical to SEQ ID NO: 996
  G656 DNA sequence used for BLAST

SEQ ID NO: 998 - DNA, 897 bp, Arabidopsis thaliana; identical to SEQ ID NO: 103
  G658 cDNA Sequence

SEQ ID NO: 999 - protein, 246 aa, Arabidopsis thaliana
  G658 Amino Acid Sequence
MNKGAWTKEEDQLLVDYIRKHGEGCWRSLPRAAGLQRCGKSCRLRWMNYLRPDLKRGNFTEEEDELIIKLHSLLGNKWSLIAGRLPGRTDNEIKNYWNTHIKRKLLSRGIDPNSHRLINESVVSPSSLQNDVVETIHLDFSGPVKPEPVREEIGMVNNCESSGTTSEKDYGNEEDWVLNLELSVGPSYRYESTRKVSVVDSAESTRRWGSELFGAHESDAVCLCCRIGLFRNESCRNCRVSDVRTH

SEQ ID NO: 1000 - DNA, 934 bp, Arabidopsis thaliana
  G658 Genomic Sequence
tctctaatgagttctaacatcagaaacccgacaattccgacacgactcattacgaaacaacccaatccgacaacacaaacacaccgcatcactctcatgagctccaaacaactcggaaccccaccgtcgagtcgactcagccgagtcaacaacactcactttccgagtcgactcgtaccgataactcggtccaacagagagttccaaattcaacacccaatcttcctcgttcccataatccttctccgacgtcgttccactactctcacaattattaaccataccaatctcttcacgcaccggttccggtttaaccggtccagagaaatcaagatgtatagtctcaacgacatcgttttgaagagacgacggagacacgacggattcgttgatcagacggtgagagtttggatcaatcccacggctgagaagcttcctcttgatatgagtgttccaatagttcttgatctcgttatctgttcttcctggtaatctcccagctattaaagaccatctataacaacaacacaaagtttcagaatctttcacaaatataatcatattcttaaaaaagtgtgagagaaagagactaacttgttaccgagcaagctatggagcttgatgatgagttcatcttcttcttcagtaaaattgcctcttttgagatctggtcttagataattcatccatctcaatctacaactcttaccacatctttgtaatcctgcacaaagttcaatcaaaaatcaaatctttacctctctgtaaatataaagaaacagaggatgtatgaataagtaccagcggcgcgagggagagatcgccagcaaccttcaccgtgtttacggatgtaatcaacaagaagctgatcttcttctttagtccaagctcctttgttcatgtgagctttctcgcagcatggtgatcttcccat

SEQ ID NO: 1001 - DNA, 775 bp, Arabidopsis thaliana
  G658 DNA sequence used for BLAST
tttccgagtcgactcgtaccgataactcggtccaacagagagttccaaattcaacacccaatcttcctcgttcccataatccttctccgacgtcgttccactactctcacaattattaaccataccaatctcttcacgcaccggttccggtttaaccggtccagagaaatcaagatgtatagtctcaacgacatcgttttgaagagacgacggagacacgacggattcgttgatcagacggtgagagtttggatcaatcccacggctgagaagcttcctcttgatatgagtgttccaatagttcttgatctcgttatctgttcttcctggtaatctcccagctattaaagaccatctataacaacaacacaaagtttcagaatctttcacaaatataatcatattcttaaaaaagtgtgagagaaagagactaacttgttaccgagcaagctatggagcttgatgatgagttcatcttcttcttcagtaaaattgcctcttttgagatctggtcttagataattcatccatctcaatctacaactcttaccacatctttgtaatcctgcacaaagttcaatcaaaaatcaaatctttacctctctgtaaatataaagaaacagaggatgtatgaataagtaccagcggcgcgagggagagatcgccagcaaccttcaccgtgtttacggatgtaatcaacaagaagctgatcttcttctttagtccaagctcctttgttcatgtgagctttctcgcagcatggtgatcttcccat

SEQ ID NO: 1002 - DNA, 984 bp, Arabidopsis thaliana
  G659 cDNA Sequence
atggggaagggaagagcaccttgttgtgacaagaccaaagtgaagagaggtccatggagcccagaagaagacattaaactcatctctttcattcaaaagtttggtcatgagaactggagatctctccccaaacaatctggtatgtcattgcttttgtcatcacaatcaaagcaaaagcctcttcaattgttttttcttttctttatgattctgaatgtatatatatgcaaaaatgaagggctattgaggtgtgggaagagttgtcgtctaaggtggattaactatcttaggccagatctgaagcgtggcaacttcacttcagaggaggaagaaacaatcattaagcttcaccacaactatgggaacaagtggtcgaaaatcgcttctcaacttccaggtagaacagataacgagatcaagaatgtgtggcacactcatctaaagaaaagactggctcagagctcaggaactgcagatgaaccggcctcgccttgttcgagtgattctgtttctcgtgggaaagatgataagtcatctcacgtagaagattctttgaacagagagactaatcataggaatgagttgtctacatctatgtcttctgggggttccaaccaacaagatgatccaaagatagacgaactcaggtttgagtatatagaagaagcttatagcgagtttaacgacattattattcaagaggtagacaaacccgatctgctggagataccatttgattcagatcctgacatttggagtttcttagatacttcaaactcatttcaacaatccactgcaaatgagaacagctcaggctcaagagcaacaacagaagaagagtctgatgaggatgaggttaagaaatggttcaagcacctagaaagcgaactcgggttagaagaagacgataatcaacaacaatacaaagaagaagaatcatcatcatcatcactcttgaagaactacgagctcatgatacattga

SEQ ID NO: 1003 - protein, 327 aa, Arabidopsis thaliana
  G659 Amino Acid Sequence
MGKGRAPCCDKTKVKRGPWSPEEDIKLISFIQKFGHENWRSLPKQSGMSLLLSSQSKQKPLQLFFLFFMILNVYICKNEGLLRCGKSCRLRWINYLRPDLKRGNFTSEEEETIIKLHHNYGNKWSKIASQLPGRTDNEIKNVWHTHLKKRLAQSSGTADEPASPCSSDSVSRGKDDKSSHVEDSLNRETNHRNELSTSMSSGGSNQQDDPKIDELRFEYIEEAYSEFNDIIIQEVDKPDLLEIPFDSDPDIWSFLDTSNSFQQSTANENSSGSRATTEEESDEDEVKKWFKHLESELGLEEDDNQQQYKEEESSSSSLLKNYELMIH

SEQ ID NO: 1004 - DNA, 1081 bp, Arabidopsis thaliana
  G659 Genomic Sequence
tcaatgtatcatgagctcgtagttcttcaagagtgatgatgatgatgattcttcttctttgtattgttgttgattatcgtcttcttctaacccgagttcgctttctaggtgcttgaaccatttcttaacctcatcctcatcagactcttcttctgttgttgctcttgagcctgagctgttctcatttgcagtggattgttgaaatgagtttgaagtatctaagaaactccaaatgtcaggatctgaatcaaatggtatctccagcagatcgggtttgtctacctcttgaataataatgtcgttaaactcgctataagcttcttctatatactcaaacctgagttcgtctatctttggatcatcttgttggttggaacccccagaagacatagatgtagacaactcattcctatgattagtctctctgttcaaagaatcttctacgtgagatgacttatcatctttcccacgagaaacagaatcactcgaacaaggcgaggccggttcatctgcagttcctgagctctgagccagtcttttctttagatgagtgtgccacacattcttgatctcgttatctgttctacctggaagttgagaagcgattttcgaccacctgatcaaaatgcagaaagcttaatgtcaatatcaaatcacttttttgatccaccatatatgtatgagcacaataataatcctagctgatgatttacttgttcccatagttgtggtgaagcttaatgattgtttcttcctcctctgaagtgaagttgccacgcttcagatctggcctaagatagttaatccaccttagacgacaactcttcccacacctcaatagcccttcatttttgcatatatatacattcagaatcataaagaaaagaaaaaacaattgaagaggcttttgctttgattgtgatgacaaaagcaatgacataccagattgtttggggagagatctccagttctcatgaccaaacttttgaatgaaagagatgagtttaatgtcttcttctgggctccatggacctctcttcactttggtcttgtcacaacaaggtgctcttcccttccccat

SEQ ID NO: 1005 - DNA, 1081 bp, Arabidopsis thaliana; identical to SEQ ID NO: 1004
  G659 DNA sequence used for BLAST

SEQ ID NO: 1006 - DNA, 1104 bp, Arabidopsis thaliana
  G660 cDNA Sequence
atgaaagagagacaacgttggagtggtgaagaagatgcattgttacgtgcttacgttagacagttcggtccgagagaatggcatcttgtgtctgagcgtatgaacaaacctttgaaccgtgacgccaagtcttgtttagagagatggaagaattatcttaagccagggatcaagaaagggtctttgacagaggaagagcagaggcttgtgatccgtcttcaggagaaacacggcaacaagtggaagaagattgctgctgaggttcccgggaggacggcaaagcggttagggaagtggtgggaagtgtttaaggagaagcaacagagagaagagaaagagagtaacaagagagttgagcctattgacgagagtaagtacgatcggattctcgagagtttcgctgagaagcttgtcaaagagcggtctaacgttgtccctgctgctgccgctgctgcaacggttgtgatggctaattcgaatggagggtttttacattctgaacaacaagttcagcctcctaacccagtgatcccgccttggttagctacttctaacaatgggaacaatgttgttgcaaggcctccctcggtaactttgacattatcgccttccacagtggctgcagctgcgcctcaaccgccaatcccgtggctgcagcagcaacagcctgagagagcagagaacggtccagggggacttgtgttagggagtatgatgccgtcttgtagtgggagtagcgagagtgtgttcttgtcagagcttgtggagtgttgtagagagttggaggaagggcaccgagcttgggcagaccataagaaagaggctgcatggaggctaagaaggctggagctgcagctagagtcagagaagacgtgtagacaaagggagaagatggaggagattgaggcaaagatgaaagctcttagggaagagcagaagaacgcaatggagaagatcgaaggagagtacagagaacagctcgttggtttgaggcgagacgcagaggccaaagaccagaaactggctgatcaatggacctctaggcatatcagactcaccaagtttcttgaacaacaaatgggttgcagattagaccgcccctga

SEQ ID NO: 1007 - protein, 367 aa, Arabidopsis thaliana
  G660 Amino Acid Sequence
MKERQRWSGEEDALLRAYVRQFGPREWHLVSERMNKPLNRDAKSCLERWKNYLKPGIKKGSLTEEEQRLVIRLQEKHGNKWKKIAAEVPGRTAKRLGKWWEVFKEKQQREEKESNKRVEPIDESKYDRILESFAEKLVKERSNVVPAAAAAATVVMANSNGGFLHSEQQVQPPNPVIPPWLATSNNGNNVVARPPSVTLTLSPSTVAAAAPQPPIPWLQQQQPERAENGPGGLVLGSMMPSCSGSSESVFLSELVECCRELEEGHRAWADHKKEAAWRLRRLELQLESEKTCRQREKMEEIEAKMKALREEQKNAMEKIEGEYREQLVGLRRDAEAKDQKLADQWTSRHIRLTKFLEQQMGCRLDRP

SEQ ID NO: 1008 - DNA, 1104 bp, Arabidopsis thaliana
  G660 Genomic Sequence
tcaggggcggtctaatctgcaacccatttgttgttcaagaaacttggtgagtctgatatgcctagaggtccattgatcagccagtttctggtctttggcctctgcgtctcgcctcaaaccaacgagctgttctctgtactctccttcgatcttctccattgcgttcttctgctcttccctaagagctttcatctttgcctcaatctcctccatcttctccctttgtctacacgtcttctctgactctagctgcagctccagccttcttagcctccatgcagcctctttcttatggtctgcccaagctcggtgcccttcctccaactctctacaacactccacaagctctgacaagaacacactctcgctactcccactacaagacggcatcatactccctaacacaagtccccctggaccgttctctgctctctcaggctgttgctgctgcagccacgggattggcggttgaggcgcagctgcagccactgtggaaggcgataatgtcaaagttaccgagggaggccttgcaacaacattgttcccattgttagaagtagctaaccaaggcgggatcactgggttaggaggctgaacttgttgttcagaatgtaaaaaccctccattcgaattagccatcacaaccgttgcagcagcggcagcagcagggacaacgttagaccgctctttgacaagcttctcagcgaaactctcgagaatccgatcgtacttactctcgtcaataggctcaactctcttgttactctctttctcttctctctgttgcttctccttaaacacttcccaccacttccctaaccgctttgccgtcctcccgggaacctcagcagcaatcttcttccacttgttgccgtgtttctcctgaagacggatcacaagcctctgctcttcctctgtcaaagaccctttcttgatccctggcttaagataattcttccatctctctaaacaagacttggcgtcacggttcaaaggtttgttcatacgctcagacacaagatgccattctctcggaccgaactgtctaacgtaagcacgtaacaatgcatcttcttcaccactccaacgttgtctctctttcat

SEQ ID NO: 1009 - DNA, 1104 bp, Arabidopsis thaliana; identical to SEQ ID NO: 1008
  G660 DNA sequence used for BLAST

SEQ ID NO: 1010 - DNA, 1441 bp, Arabidopsis thaliana
  G661 cDNA Sequence
ggaaagaagcacgtggtgaatggacatgaagagaaaaggatgctaggtttaatataaattggaataagaagcagttagtggttgtgaaggaaggaaggaggcaagcaaccaaatctcagagacaattataacagtatagagaaggaagaaagaaaagaaaaagaaaccgttgttgatttagatacagagaagagaagatcatctaacatgggaagatctcctatctctgatgactctggtctcaagaaaggtccttggactcctgatgaagatgagaaacttgtcaactatgttcaaaaacatggtcatagtagctggagagcccttcccaaactcgctggtcttaacaggtgtgggaagagttgcaggctaagatggacgaactacttgagaccagacatcaagagagggagattctctccggacgaggaacagactatcttgaatcttcattcagttcttggaaacaagtggtcaacgattgcgaatcagttaccagggagaacagataacgagatcaagaatttctggaacactcatttgaagaagaagctgattcagatgggttttgatccaatgactcaccgtccaagaaccgatatcttctccggcttatcccagctcatgtctttgtcttctaacctgagaggctttgttgatctgcaacaacagtttcctattgatcaagaacacactatactcaaactccaaaccgagatggccaaactccaattgttccaataccttcttcaaccgtcttccatgagtaacaatgttaaccctaatgactttgacactctcagtctccttaactctattgcctctttcaaagagaccagtaataataccaccagcaacaatctcgacctcggtttcctcggctcttatcttcaggacttccacagcttaccttccctgaaaaccctaaattccaacatggaaccatcatctgttttcccccagaatcttgatgacaatcacttcaaattctccactcaaagagaaaacctacccgtgtctccaatctggctctcggatccatccagcacaactcctgctcatgtgaatgatgatctgatttttaaccaatacggtattgaagatgtcaatagcaatatcacatcttcaagcggtcaagaatcaggagcttcagcttcagctgcatggcctgatcatctattggatgattctatattttccgacattccttagccttcttttgtctttactttcaggtatgtactttggaggaactcaaatcaaatttactcttggaattgtgcttgttggagatttttatttgcctatctatatatatataaatactgtagagacatcatatatttgtaactcatgttgtagaatgtacagtacagagatttcatactcatatgcatatgttgttgtcaatgttctttagcaaaaaaaaaaaaaaaaaaaa

SEQ ID NO: 1011 - protein, 334 aa, Arabidopsis thaliana
  G661 Amino Acid Sequence
MGRSPISDDSGLKKGPWTPDEDEKLVNYVQKHGHSSWRALPKLAGLNRCGKSCRLRWTNYLRPDIKRGRFSPDEEQTILNLHSVLGNKWSTIANQLPGRTDNEIKNFWNTHLKKKLIQMGFDPMTHRPRTDIFSGLSQLMSLSSNLRGFVDLQQQFPIDQEHTILKLQTEMAKLQLFQYLLQPSSMSNNVNPNDFDTLSLLNSIASFKETSNNTTSNNLDLGFLGSYLQDFHSLPSLKTLNSNMEPSSVFPQNLDDNHFKFSTQRENLPVSPIWLSDPSSTTPAHVNDDLIFNQYGIEDVNSNITSSSGQESGASASAAWPDHLLDDSIFSDIP

SEQ ID NO: 1012 - DNA, 1181 bp, Arabidopsis thaliana
  G661 Genomic Sequence
atgggaagatctcctatctctgatgactctggtctcaagaaaggtccttggactcctgatgaagatgagaaacttgtcaactatgttcaaaaacatggtcatagtagctggagagcccttcccaaactcgctggtaatgcttttgtgttctttctttcttgaaagcttgtcttaagtctaagcttctcatgtgattctctctgtgcaggtcttaacaggtgtgggaagagttgcaggctaagatggacgaactacttgagaccagacatcaagagagggagattctctccggacgaggaacagactatcttgaatcttcattcagttcttggaaacaagtaattaatcttgtgatgattgttttgatgttttagtcaacggttttgtttgtgtaccagattatcttatactgattgcttatgaatgatgatgttataaggtggtcaacgattgcgaatcagttaccagggagaacagataacgagatcaagaatttctggaacactcatttgaagaagaagctgattcagatgggttttgatccaatgactcaccgtccaagaaccgatatcttctccggcttatctcagctcatgtctttgtcttctaacctgagaggctttgttgatctgcaacaacagtttcctattgatcaagaacacactatactcaaactccaaaccgagatggccaaactccaattgttccaataccttcttcaaccgtcttccatgagtaacaatgttaaccctaatgactttgacactctcagtctccttaactctattgcctctttcaaagagaccagtaataataccaccagcaacaatctcgacctcggtttcctcggctcttatcttcaggacttccacagcttaccttccctgaaaaccctaaattccaacatggaaccatcatctgttttcccccagaatcttgatgacaatcacttcaaattctccactcaaagagaaaacctacccgtgtctccaatctggctctcggatccatccagcacaactcctgctcatgtgaatgatgatctgatttttaaccaatacggtattgaagatgtcaatagcaatatcacatcttcaagcggtcaagaatcaggagcttcagcttcagctgcatggcctgatcatctattggatgattctatattttccgacattccttag

SEQ ID NO: 1013 - DNA, 1181 bp, Arabidopsis thaliana; identical to SEQ ID NO: 1012
  G661 DNA sequence used for BLAST

SEQ ID NO: 1014 - DNA, 1033 bp, Arabidopsis thaliana; identical to SEQ ID NO: 38
  G663 cDNA Sequence

SEQ ID NO: 1015 - protein, 249 aa, Arabidopsis thaliana
  G663 Amino Acid Sequence
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 1016 - DNA, 1310 bp, Arabidopsis thaliana
  G663 Genomic Sequence
tcaagttcaacagtctctccatcaaacagactccaaagttgctcaacgtcaaacgccaaagtggccccatgttcagctgtcgtcgcttcaggaacaatcgcatcagcttcttggttttcccccagtaaattctccaaccacatattatctccattcattagattattcacaaaatcatctttctcatcatctttgttacatgtgatactattttcacaaacattatttttcttgagtccaaggcatgaaggaattaaatcaacttctggcagaccattgagatggctgcaaccattgttaacagagaaggatcgaggtcgaggcttaaaaacaccgattttttggaccggtgttgtaggaggggaaataatgtttttctttttcattttagacttacaacacgaagactcatgttttttactcagatgggtgttccagtaatttttgacatcattagcggtccgaccaggcaatcgaccagcaatcaaggaccacctaaacattgttaaataatatacatataagttattagtgttgaacttatggctcttgaaataaccattaaagtaaacaatacctatttcctagaagcttatgaaggcgaagaagaagatcaacttcatcattgctaagtcttcctctcttgatacttggcttcaaatagttcaaccatcttagtctacaactctttctgcatcgatttagccctacataaccaatagttgacattaattataccaaccaagacggcttttgggtcattttctatgtttcatcttgaagaatctaagcacaccaatagaaagattaaactgtttcaacacagtaaccgtttgttcataaattttcactgacttcactcaccagaagacagcccagtgaaatagtttaacaactttacatgagcttagcatcttccttgtttgtgaagaataagctatatatatatatatatatatatatatatatatatatatgctacgtaaataaaaaatagtataacttttttatttatataaaactcttcgtttaaataaactgcataaagaattattctgaataaccagttgttttttttgtttttttttgttttaccatacactagcatatgaatcaataatttgctccttaaaacaaaaagaaaagtaaaataaagatttccgaatattatatatagagaagagaatattcttagtcatgaatatatctgtgtgtgtaacataccagctctcaaaggaacttgatgccatttgccttctccatacttatcaatacatagcctcaagagactatcttcttcagcagtccat

SEQ ID NO: 1017 - DNA, 1310 bp, Arabidopsis thaliana; identical to SEQ ID NO: 1016
  G663 DNA sequence used for BLAST

SEQ ID NO: 1018 - DNA, 1087 bp, Arabidopsis thaliana; identical to SEQ ID NO: 29
  G664 cDNA Sequence

SEQ ID NO: 1019 - protein, 282 aa, Arabidopsis thaliana
  G664 Amino Acid Sequence
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 1020 - DNA, 1011 bp, Arabidopsis thaliana
  G664 Genomic Sequence
atgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaagtgagtactatactctctaaatatgggcttatttaactagctagtatcgtttatacccaaaaaaaaacaaaaaaaactagtatcgttttaatttatacaaaatgaaaatcttggagttttcaatctatctaaatgatgttattttttgttgatgatatatagatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataa

SEQ ID NO: 1021 - DNA, 1011 bp, Arabidopsis thaliana; identical to SEQ ID NO: 1020
  G664 DNA sequence used for BLAST

SEQ ID NO: 1022 - DNA, 1158 bp, Arabidopsis thaliana
  G665 cDNA Sequence
ccaacttggacaacatcatttaaattataaaaccctccaataaataaaacttggtttatccaatcatcttatttctctgtgctctccaccattttacataaaccccaaaatctctcttcatcatcatcattcatcaacatcatctctctttctctatctcgctgtccctccttctctttctcattcattgcaatgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtgaatctatataacacgttatgatcagtttcattagaataattcaaatgtttacatatataatatcttatcgatcctatctaatttgattttgatttaacgttagttactttgataatttcgtcgatattgtttttttggttttttcattgtgagattttttgtcttggaagttggatccatacatatttctgtaaaactttatatttaaggtatatatatctagcgctcataaaagtttcaatattccaaaaaaaaaaaaaaaaaa

SEQ ID NO: 1023 - protein, 233 aa, Arabidopsis thaliana
  G665 Amino Acid Sequence
MGRRCSHCGNVGHNSRTCSSYQTRVVRLFGVHLDTTSSSPPPPPPPSILAAAIKKSFSMDCLPACSSSSSSFAGYLSDGLAHKTPDRKKGVPWTAEEHRTFLIGLEKLGKGDWRGISRNFVVTKSPTQVASHAQKYFLRQTTTLHHKRRRTSLFDMVSAGNVEENSTTKRICNDHIGSSSKVVWKQGLLNPRLGYPDPKVSVSGSGNSGGLDLELKLASIQSPESNIRPISVT

SEQ ID NO: 1024 - DNA, 1364 bp, Arabidopsis thaliana
  G665 Genomic Sequence
atgggcagaagatgctcacactgtggaaacgtaggacataactcaagaacatgttcttcttaccaaacaagagtagttaggctctttggtgttcatctagacaccacaagctcttctccgccgcctcctcctcctccctcgattttggccgctgcaataaagaaaagtttcagcatggattgcttgccggcatgttcctcctcttcctcttcctttgctggttatctctccgatggtctcgcccataaaacacctgaccgcaaaaaaggttacaactttgacatattatgccactttccgagtttttttttacaataggatagtgacgtttttttattaatccaaaagttccgggtattaggcccataatcgatttgtatcggagatcaaaacatgttaaactggtcatcggtgggattggttttgccataaagattttgtacgtatatccaagtcggaccatttcctaaagcatgcaaccgctatatatataagagtagtcaagaaaatgatgtgtctataacgcgatctttagcctaggattttgttaaaagtttttccaaaaataataatttgtgtttccgtaattaggggttccatggacggcggaagagcaccggacgtttctaattggattagaaaagcttggaaaaggagattggagaggaatctctagaaacttcgtcgtcacaaaatccccgacacaagtggcaagtcatgctcaaaaatactttctccggcaaactaccactctccatcacaagagacgccgcaccagcctctttgatatggcaagtaattccaatcttttctctatacatgcatgacaaaagaatttaaactctttgtatcaaacttttatgtattaaatcaaaatgtttctgtatccaacaaaagtcacatcttcaaaagttcaaacagaatttttatgttgttttaaaagttttctttccaagtttttttttcccacttaaaatatcggaattttctaaaccaaaaattagtcaagattttaagtttaatctaagctttattttaataccaagtatatatgaacatataatttcttgtagaatccgaagaaaaaaatagaaaataatcttgaattgacaaatttttatattcaacaggtttcggccggcaatgttgaagaaaatagtactactaagaggatatgtaatgatcatattgggtcgagctcaaaggttgtttggaaacaaggattactcaatcctcgtcttggatatccagatccgaaagtatcagtatccggctcgggtaactccggtggactcgatcttgagctgaagcttgcgtccattcaatctcctgaatcgaatattagacctattagcgttacgtga

SEQ ID NO: 1025 - DNA, 1364 bp, Arabidopsis thaliana; identical to SEQ ID NO: 1024
  G665 DNA sequence used for BLAST

SEQ ID NO: 1026 - DNA, 1310 bp, Arabidopsis thaliana
  G666 cDNA Sequence
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 1027 - protein, 323 aa, Arabidopsis thaliana
  G666 Amino Acid Sequence
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 1028 - DNA, 1414 bp, Arabidopsis thaliana
  G666 Genomic Sequence
atggtgaggcctccttgttgtgacaaaggaggagtgaagaaagggccatggactcctgaagaagatatcattttagtcacttacatccaagaacatggtcctggtaattggagagctgttcctaccaatactggtatgtataatcttcattcatcatctctcctctctacctctctatagatttgtatgtagatattatttggatttaatctatgagagtgagagatagacaaggaatcaaattggtttggattgaaatttgtgttctccaaattggttttgatcttcatttggttcttctttaggtctttaagattgtggaatcagcttaatgaaaacatatgtagaaattagggttttgtttattgaccatgaaattaagatctaatgcatgagatcttgttatttatatattttctcatcggttctcaatatttgttcgttcttataaattttcagggctgcttagatgcagcaagagttgtagacttagatggacaaactatttaaggccaggaatcaaaagaggcaatttcacagaacatgaagaaaagatgattgttcatctccaagccctcttaggaaataggtaaaaaataataatgacttttcaatttctctaattttgtctcttcacacattttctttcgaaaattagaagatttgttttgatttttaatagagagcatttaatatttggtgtagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctga

SEQ ID NO: 1029 - DNA, 1414 bp, Arabidopsis thaliana; identical to SEQ ID NO: 1028
  G666 DNA sequence used for BLAST

SEQ ID NO: 1030 - DNA, 1056 bp, Arabidopsis thaliana; identical to SEQ ID NO: 45
  G668 cDNA Sequence

SEQ ID NO: 1031 - protein, 351 aa, Arabidopsis thaliana
  G668 Amino Acid Sequence
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 1032 - DNA, 1425 bp, Arabidopsis thaliana
  G668 Genomic Sequence
ctagaacatcccttcttgtcctgctagtgccataccaaccatctcgtggctttgctcatcaaataaccatttctcaaacaaagacagagacccttgtgatattagaccatgatcttggtccattgttatttccggtttgatcacttgatcatggaagaagcttgtctcctgagtcaagttttgagtttcgtccattgaattgaagctgaagaaagattgttcaaacccttctccaccttcttccgagactgcagcagtgagtggtccagtctctgaaaccggagatgaagatgataaagttaaagccttgggtgtgtctttcatgaaatcttgaagcaaccgggcgatgttctcagcacttgacgcatatacccctgatgggtatggattagtagtgttgcttgtagtggtggttgtggtagatgaagaagaagaggatggatcataacaacggtcaagcaaagctgatgagaagttacggatgttttgttgtgtgattactggtgtcggtaatgatgaagatgatgaaagagtggatgatggtttgtctaaagacaaggcctcacaaagagcttgttttgccatgttaatgtctgtctgaagtcttctttcccattgacctttgttagtgctttgatggttcttttgtgaactagtgtttgatgaagagacaccatcattatcttcttcaccagattcattaatctttttgagcttcttcttcaagtgagtgttccaatagttctttatatcattgtctgtcctttctggaaggtatgatgctatggctgcccatctatatacaaagaaaaacatatttagatcttatacccaagaaaggtaactttttggaaaaatatggatcatgtgcattaaaatatacctgttgcctaaaagggcttgaagatgaacaattgtcttctcttcatgctcagtaaaatttccacgcttaataccgggtcgaagataattagtccatctcaatctgcagctcttgctacatcttctcaaacctaaaacaccatattaacaaaacaattaactcaaggaaaaagggattaaatggtaattagagatatgtggacgaaagagtcggtgacataacttattagctatttattacacttttattaaatgttcataccaaccaagccagagaaagaaataaaaaagagaagaaatcacaacccctagtacactttcaagataaatacataaaaagggtttaagaggtggatcaaaagtttaattaatctattaattagttaatttgattaagaaacaaaacaaacctgtgtgtgttgggacagatctccagtttccaggaccatgttcttggatgtaagaaaccaagatgatgtcttcctctggtgtccatggccctttcttcactccaatcttttcacagcaaggtggtcttcccat

SEQ ID NO: 1033 - DNA, 1425 bp, Arabidopsis thaliana; identical to SEQ ID NO: 1032
  G668 DNA sequence used for BLAST

SEQ ID NO: 1034 - DNA, 923 bp, Arabidopsis thaliana
  G669 Genomic Sequence
atgggaaagagagcaactactagtgtgaggagagaagagttaaacagaggagcttggactgatcatgaagacaagatccttagagattacatcaccactcacggcgaaggcaaatggagcactctccctaaccaagctggtactaatctctctatctaccgatccgtctttatatcttctacgtacaataattgtcttggcacacataaaaggtctcaagaggtgtggcaaaagctgtagacttcggtggaagaactacctaagaccggggataaagcgcggtaacatctcatctgatgaagaagaactcataatccgtctccataatcttcttggaaacaggtttttcactaaccacatagaattttctttttgtagtaaagttatttgttatgtgacattataattaaagcagatggtcgttgatagctgggaggcttccaggccgaacagacaatgaaataaagaatcattggaactcaaacctccgcaaaagacttcccaaaactcaaaccaagcaaccaaaacgtataaaacattcgacgaacaacgagaataatgtatgtgttatacgtacaaaggcgattaggtgctcaaagactcttctcttctcggatctctctcttcagaagaagagtagtactagtccactacctctgaaagaacaagagatggatcaaggtggatcttcgttgatgggagatctcgaattcgatttcgataggatccattcggagtttcacttcccggatttgatggattttgatggtttggactgtggaaacgttacatctcttgtttcatctaacgagattttgggagagttggttcctgctcaaggtaatctcgatctcaatagacctttcacttcttgtcatcatcgtggcgacgatgaagattggctccgagacttcacttgttga

SEQ ID NO: 1035 - DNA, 923 bp, Arabidopsis thaliana; identical to SEQ ID NO: 1034
  G669 DNA sequence used for BLAST

SEQ ID NO: 1036 - DNA, 1307 bp, Arabidopsis thaliana
  G670 cDNA Sequence
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 1037 - protein, 374 aa, Arabidopsis thaliana
  G670 Amino Acid Sequence
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 1038 - DNA, 1741 bp, Arabidopsis thaliana
  G670 Genomic Sequence
atggggagacattcttgctgttacaaacaaaagctgaggaaagggctttggtctcctgaagaagacgagaagcttcttactcacatcaccaatcacggccatggctgctggagctctgtccctaaactcgctggtaacatttcttcctttattccaagaaacaaacgaagaagctactttttgtaataacaacagctgagtcttcttctacaggtttgcagagatgtgggaagagttgtcgactaagatggatcaattacttgagacctgatttaaagagaggagctttttctcctgaagaagagaatctcatcgtcgaacttcatgccgtccttggaaacaggtaataattagttatcaacaataatgctgtctaagaaaaaatatcatagaaaacagaggatcatgtttatgttttcagcttcattcctctgttttttgctctgctctgttttaacagaggatcaagtttatgtcttaagcctcctctgtttttggctttggtctgtttatactcagatggtcacagattgcgtcaaggcttccgggtagaaccgacaacgagatcaagaatctatggaactcaagcatcaagaagaaactgaaacaaagaggcattgacccaaacacacacaagcccatctctgaagttgagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttatttttgaagcgtgttttatacgtcaaagattcttctttcttttgcaaaacctttcagtatcatactaaatacttttgtttttgttaagattttatgtatagtattcttgatgattcatcagagaggtctgtgtttgccattaatctgttgaagaacaatgatgaacgcaataaatctgtttctgtctgtttccgtgaacgaattgtgatccatagtcacatccttcaccatttttcagacctgtaa

SEQ ID NO: 1039 - DNA, 1741 bp, Arabidopsis thaliana; identical to SEQ ID NO: 1038
  G670 DNA sequence used for BLAST

SEQ ID NO: 1040 - DNA, 1384 bp, Arabidopsis thaliana
  G671 cDNA Sequence
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaaaaaaaaaaaaaaaaaaaaaaa

SEQ ID NO: 1041 - protein, 352 aa, Arabidopsis thaliana
  G671 Amino Acid Sequence
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 1042 - DNA, 1262 bp, Arabidopsis thaliana
  G671 Genomic Sequence
tcatccaaaatagttatcaatttcgtcaaacaagtcttgacgttcatagaccggcgtcacatcaacgacgtcgttttcatcctcgtgaagaaacctcgtaagttctttcatgaacgcagtgttttcaacacaagactcctccaacatcatgaaatcttcatcattcagaaatgtggagaacccgatagtatcctcatcatcaacgttgttattaccaacgaaattatcgcagtacattagaggattgttaacggaggaatcagagaacgtggacgaagaacacgtcagattaacgttaccatcaacgtcaaagttcgatgaaactggtgttgttgcaacggtcccatggcagagaagattcgaggttggtgcgaaggaagaactcgttgacttaactgattcagagtcaacggaaacacttgtagttgtagtattagtagtgtgactagtagaagcaagtgggcctccacttccgataatctcagacagaacactctgattgattctctttccgaacctattagctactttgttcaagaaactagccgatgataatccaaaattcttgttgttcttcttcgccttgtcattatcaagatcatggtcactagttgtcagattaacattttgtttctccgggaggttttctgatttgtcggtaccggaggttatgcccttgtgtgtaactggatcaatacctttcttgatcaaacgttttttgatatgagtgttccagtagttcttgatctcgttatcggttcttcctggtagtccacgagctatagcagaccatctgattaaaaccacatataagattacaatattagtaaatgttaatgcaaacaaaaaataagtataaaatgtagaggtagagagactaacttgttgccgtgaagggcgtgaagagagatgattgaacgttcttcgtcttcagtgaactctcctcttttgatgtcaggtctaagataattggcccatctcagtctgcagcttttgccgcatctcttgagtcctatccaattagaagaattatttaagtaaaataattgagcaataatgaccaataaaggtccaacattgaatattcaaacatgacggaataaacataataaaaaataatacataccagctttttcggggagagttcgccatccaccttcaccgtggcggttaaggtaagagagaagcttctgatcttcctcgggagtccaagctcctttctttaaccctagttcagctttgcaacacggtgtccgcaccat

SEQ ID NO: 1043 - DNA, 1262 bp, Arabidopsis thaliana; identical to SEQ ID NO: 1042
  G671 DNA sequence used for BLAST

SEQ ID NO: 1044 - DNA, 1386 bp, Arabidopsis thaliana
  G672 cDNA Sequence
tttgtctctctatctctttctcacaattagattctgtgcttcttctgcgatcaactaagatccgatccgcgagcgtttcagacttcgatcagatccgattaagagaagcaaatcgggtcgggtatgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataaaagacctgaggaagtgatggtctaaaatgggatctggtttggggtttacaggttagttgttggtcacagtaacttaaataagtttttctttgttaggttgtttaacttgggtaggatgttttagttcagctttgatcgttagggaaaagaaaaaaaaaaaaaaaa

SEQ ID NO: 1045 - protein, 365 aa, Arabidopsis thaliana
  G672 Amino Acid Sequence
MTRRCSHCNHNGHNSRTCPNRGVKLFGVRLTEGSIRKSASMGNLSHYTGSGSGGHGTGSNTPGSPGDVPDHVAGDGYASEDFVAGSSSSRERKKGTPWTEEEHRMFLLGLQKLGKGDWRGISRNYVTTRTPTQVASHAQKYFIRQSNVSRRKRRSSLFDMVPDEVGDIPMDLQEPEEDNIPVETEMQGADSIHQTLAPSSLHAPSILEIEECESMDSTNSTTGEPTATAAAASSSSRLEETTQLQSQLQPQPQLPGSFPILYPTYFSPYYPFPFPIWPAGYVPEPPKKEETHEILRPTAVHSKAPINVDELLGMSKLSLAESNKHGESDQSLSLKLGGGSSSRQSAFHPNPSSDSSDIKSVIHAL

SEQ ID NO: 1046 - DNA, 1098 bp, Arabidopsis thaliana
  G672 Genomic Sequence
atgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataa

SEQ ID NO: 1047 - DNA, 1546 bp, Arabidopsis thaliana
  G672 DNA sequence used for BLAST
atgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggtatcttcgtttgatttctgagattaaattttttatcaaattccaaatttttgtaattgagtttattttgcatcaaagtcgttgattgcattatgtaacaagtggtgatctggtttatgtaacaagattttgatgtgtgtttgatattggttttgttgtaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggtttgttccttcttcattcaaaaacaccatttttatttatattggagtggttacaaaatgtgttgagatactgatttaaaggattcagaagcttattaggtggattggtttgccttctacatttcaatatgaaaagttgaagtctgttggggttctaattgatatgcttgaggatatcattttgtagccaatcctgcttaagcattttggtcttctcatgggaatgtgatcttgaaatgtaattctctttctttattctgcttatgctgtgtgatttgtccttgtaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataa

SEQ ID NO: 1048 - DNA, 1237 bp, Arabidopsis thaliana
  G673 cDNA Sequence
tctctctctaaccccttctctcttcagtctctctctctctagacgatctctatcttgaataaaataccgataatgacctcaaccaatccggtggtcgccgaagtaataccggcggaaacttctacagatgctacagagacgacgattgcaacgacggaagctggtgaagcaccggagaagaaggtgaggaaagcttatacaatcaccaagtctagagagagttggactgaaggagaacacgacaagtttctggaagctcttcaattgtttgatcgtgactggaaaaagatagaagattttgttggttcaaagacagttattcagatcaggagccatgcccaaaaatactttctaaaggtccaaaaaaatgggactttagcacatgttccaccccctaggcctaagcgcaaagctgctcatccatatcctcaaaaggcatcgaaaaatgctcaaatgtcgcttcacgtttccatgtcctttcctactcaaataaataacctgcctggatatactccatgggatgatgatacatctgcattgttaaacattgctgtaagtggggttattccaccagaagatgaacttgatactctttgtggagcagaagttgatgttggatcaaatgacatgataagtgaaactagtccttcagcatctggtatcggaagctcaagcagaacactatcagattctaagggtttgagactggcgaaacaagctccctcaatgcatggtcttcctgattttgctgaggtttataacttcattgggagtgtgttcgatcctgacagcaaaggccgcatgaaaaagctcaaggaaatggatcctataaatttcgaaactgttttgctgttgatgagaaacctcacagtgaacttgtcaaaccctgactttgaacctacttctgaatatgttgatgctgcagaggaaggtcatgaacacttaagctcttagctgtttgtgcactcaacaagttatatatcttcttgacgacttcttgctcgcaacaactctctaccagctatcaaatgcatcgtacggttgttgtctgaggagaacataactgagtcgtcgtcacaaacaagaggaacatatgcagtttcggtcagaaccagtcgtgtgaatggtagatatatgtatgtgtgtgtagaaaatggttaccaattgtatcttctttttgataattattttttcatgccttttgtaatatgtaagtttctttaaaaaaaaaaaaaaa

SEQ ID NO: 1049 - protein, 293 aa, Arabidopsis thaliana
  G673 Amino Acid Sequence
MTSTNPVVAEVIPAETSTDATETTIATTEAGEAPEKKVRKAYTITKSRESWTEGEHDKFLEALQLFDRDWKKIEDFVGSKTVIQIRSHAQKYFLKVQKNGTLAHVPPPRPKRKAAHPYPQKASKNAQMSLHVSMSFPTQINNLPGYTPWDDDTSALLNIAVSGVIPPEDELDTLCGAEVDVGSNDMISETSPSASGIGSSSRTLSDSKGLRLAKQAPSMHGLPDFAEVYNFIGSVFDPDSKGRMKKLKEMDPINFETVLLLMRNLTVNLSNPDFEPTSEYVDAAEEGHEHLSS

SEQ ID NO: 1050 - DNA, 2419 bp, Arabidopsis thaliana
  G673 DNA sequence used for BLAST
atgacctcaaccaatccggtggtcgccgaagtaataccggcggaaacttctacagatgctacagagacgacgattgcaacgacggaagctggtgaagcaccggagaagaaggtgaggaaagcttacacaatcaccaagtctagagagagttggactgaaggagaacacgacaagtttctggaagctcttcaattgtaattttaccgcgctctttttttcttccaccagctatttgattgactgattctttgtgtttcgagctctaatttatagctgaattttgcgtaatttcgcgtaatttctacttaatttgcttaatcagatcgaagtttggttatgtggtagatcatctggagttttgcgtatgcaattggattttgcagaagcaacaatgtcttctttgatttgttaggttggattgtatattcgatagatcagaatttatattaatcgctgatgaatgtttcttctcataaaaccgaagtatggtttaagcttatcttaggttgccaaaatgattgagtagaggacttggcatctggtttctgcataaatagtggtattttgcagaagtcgtatctttctttattaaaaatgtttaacatgagaactgaaaaaacttactacaagtcagcttttagagctatgcatgaaaccaatttccaactacagtcctaaactacaattcagattttggtaatggttcgttacttccacatattacattgctcttttgtgtgtgtgaaaggcttctctctcttttagaaaaaagaatcttactttgtcctgacaattttctcgtgtccttaggtttgatcgtgactggaaaaagatagaagattttgttggttcaaagacagttattcaggtttgagatcagcttctttggatttttggtttaatatacaaccttggcacatttccccactcaatcatcctgtgcctgtttgatttactgcagatcaggagccatgcccaaaaatactttctaaaggtccaaaaaaatgggactttagcacatgttccaccccctaggcctaagcgcaaagctgctcatccatatcctcaaaaggcatcgaaaaatggttagttctattgtaatagatattactttgggttgacagatggagtaacatgtaatcaatctgatttcaactcaaatctgcagctcaaatgtcgcttcacgtttccatgtcctttcctactcaaataaataacctgcctggatatactccatgggatgatgatacatctgcattgttaaacattgctgtaagtggggttattccaccagaagatgaacttgatactctttgtggagcagaaggcatgcgttctcatctgtactcagtttttatattttgctttggtagtctagtcactctatcttctgaagttttcatatgctaaatgcggcttacatatcattgtttcagttgatgttggatcaaatgacatgataagtgaaactagtccttcagcatctggtatcggaagctcaagcagaacactatcagattctaagggtttgagactggcgaaacaagctccctcaatgcatggtaattatctgaacaattgagggactatttcttagttttcattttgtggtggacgctgttgtaatggttgctttgcaggtcttcctgattttgctgaggtttataacttcattgggagtgtgttcgatcctgacagcaaaggccgcatgaaaaagctcaaggaaatggatcctataaatttcgaaactgtgagttggagctttacttgcctttagattaactgatatgtgtgttgcagcatatcaatcatttagtcttcttctttgagttcccgaataaattcagctgtgtgagaagataaatataaagatcagtacttgcaatatatagattcacgagttggaaacaccaaaaagccaaagtaccatgattctatggagatgttggtcaaataatgggattgttacaaccatgagtcagttttaggtgtcatggtacctatttgtagctgtcagtgattgttctttttcctagtatccgtcactaatcacagtttttcttgcaggttttgctgttgatgagaaacctcacagtgaacttgtcaaaccctgactttgaacctactgtaagttataattttatcattacttctgtgctcgttgagtatgtgaggcacatttgtcttttcgtgataagaatgagtgagaaaaagtctctaacagctaacaaacctacttactatctgccttgaagtttaactatagaaattaagactagttcgcctttagtgtgttatgtttttaaccgttccaatgattaaatgaggattgttgtgctctatgagatataatctaaccataatttagtctgaatatgttgatgctgcagaggaaggtcatgaacacttaagctcttag

SEQ ID NO: 1051 - DNA, 1292 bp, Arabidopsis thaliana
  G675 cDNA Sequence
taatcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgttagtcttttgtttaaaaaaaaaaaaaaaaaaaa

SEQ ID NO: 1052 - protein, 365 aa, Arabidopsis thaliana
  G675 Amino Acid Sequence
MGRSPCCDENGLKKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKLIQMGIDPVTHQPRTDLFASLPQLIALANLKDLIEQTSQFSSMQGEAAQLANLQYLQRMFNSSASLTNNNGNNFSPSSILDIDQHHAMNLLNSMVSWNKDQNPAFDPVLELEANDQNQDLFPLGFIIDQPTQPLQQQKYHLNNSPSELPSQGDPLLDHVPFSLQTPLNSEDHFIDNLVKHPTDHEHEHDDNPSSWVLPSLIDNNPKTVTSSLPHNNPADASSSSSYGGCEAASFYWPDICFDESLMNVIS

SEQ ID NO: 1053 - DNA, 1457 bp, Arabidopsis thaliana
  G675 Genomic Sequence
atggggaggtcgccttgttgcgacgagaatggtctaaagaaagggccatggactcctgaagaagatcaaaagcttattgattacattcataaacatggtcatggaagctggagagctctccccaagctcgcaggttttttcctttccctagtctcttaactcaatccatgatcattttatataaacttgtatacgtatatatggattatttgaattgtatagttttgaaacttcttgtttttcttttcagatttgaataggtgtggaaagagttgtagactgaggtggacaaattatttgagaccagacatcaaaagaggaaagttttcagccgaagaagagcaaacaatcctccatctccactccattctcgggaataagtaagtgactaaacatatattcattttttttttgttataaaactttgaatgactaatactttttttttttatcatgtatagatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgttagtcttttgttt

SEQ ID NO: 1054 - DNA, 1457 bp, Arabidopsis thaliana; identical to SEQ ID NO: 1053
  G675 DNA sequence used for BLAST

SEQ ID NO: 1055 - DNA, 612 bp, Arabidopsis thaliana
  G676 cDNA Sequence
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 1056 - protein, 203 aa, Arabidopsis thaliana
  G676 Amino Acid Sequence
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 1057 - DNA, 1083 bp, Arabidopsis thaliana
  G676 Genomic Sequence
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtctctttcctctctatctctctctctaatcgtattgacataatctatgaattctttgtcacatgattttcttttacgaatggtttaaagttaaggttctatatattatatatgttattttagatttaacttttaatctatgttaatagagtccatatatcgcaaaagcaacttgaatcaggatatttatctagggtcacctttttgttgtttttatttttatgaattaaggtcctcagttaaataattgtatatgtgtgttaggtttaaagagatgtggaaagagttgtagattgaggtggatgaattatctcagccctaatgtgaaaagaggcaatttcaccgagcaagaagaggatcttatcattaggctccacaagttgcttggtaataggtataacttcatttgctcaaaattagtttctctactcaattaatcataaaaacagctatttctatccattttgtatcaagttaaataatcataaatattcgtgattgtcttcacaaacttgcttggcaacacatgtttttattctcaaaatttcaatacattatatttcacatgataattaaaatgtttatctgtgtgtttaattaggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 1058 - DNA, 1083 bp, Arabidopsis thaliana
  G676 DNA sequence used for BLAST
tcaaaaacagtgtccatctataaagtccatcatgttggtgagtgtgctaagctcaaactcatcctcatgaacccaaagtgaactcaagtagttacttccttgatgatcttcttgaatttcatctccgaggatattattgttatcgacaatattcgagattttcgtttcttctgatgtttcggtaggattcgggagattgatttgataaacaatatcaccattgctctgtttggttttctgatctttgattccgagtttcttactaagatgcgtgttccaatagttcttcacttgattatccgttcgacccggcactcttttagcaattaaagaccacctaattaaacacacagataaacaatataattatcatgtgaaatataatgtattgaaattttgagaataaaaacatgtgttaccaagcaagtttgtgaagacaatcacgaatatttatgattatttaacttgatacaaaatggatagaaatagctgtttttatgattaattgagtagagaaactaattttgagcaaatgaagttatacctattaccaagcaacttgtggagcctaatgataagatcctcttcttgctcggtgaaattgcctcttttcacattagggctgagataattcatccacctcaatctacaactctttccacatctctttaaacctaacacacatatacaattatttaactgaggaccttaattcataaaaataaaaacaacaaaaaggtgaccctagataaatatcctgattcaagttgcttttgcgatatatggactctattaacatagattaaaagttaaatctaaaataacatatataatatatagaaccttaactttaaaccattcgtaaaagaaaatcatgtgacaaagaattcataaattatgtcaatacgattagagagagagatagagaggaaagagaccagtctttttggcaatacgattccagtgacctttgccatgagctttgacataatccatgaggattttgtcttcttctactgtccacaaacctttcttgtactcattgtttccttcgtcaccactactacttactttctttctcat

SEQ ID NO: 1059 - DNA, 1187 bp, Arabidopsis thaliana
  G677 cDNA Sequence
cctacatccgtatgcctatatataggtggttgcaaggcttacccaaatctctcttcaacttgccataacatttactctctttggacaaagacacagacagagagatagataaaaacagagaattgtcatagaaccaattcagagagaacgagagagagagagagagaaatggggagacaaccatgctgtgacaaagtagggttgaagaaaggaccatggactgcagaagaggataggaagctcataaacttcatccttaccaatggacaatgttgttggagagctgttcctaagctttctggtcttcttaggtgtggcaagagttgcagacttcgttggactaactatcttagaccagaccttaagagaggtcttctctctgattacgaagagaagatggtcattgatctccattcccagcttggaaacaggtggtcaaagatagcttctcatttaccaggaagaacagacaacgaaatcaagaatcattggaacactcacatcaagaagaagttgaggaaaatggggattgatcctcttacacataaaccactctctatcgtcgaaaaagaagacgaagaacccttaaagaagctacagaataatacagttccttttcaagaaacaatggagcgtcctttagagaacaacatcaagaacatatcaagacttgaagagtctttaggtgatgatcaattcatggagataaatcttgagtatggtgtcgaagatgtccctcttattgaaacagagtctttagaccttatctgcagcaattcaacaatgtcttcatccacgtccacatcttcgcattcttctaatgattcgagtttcttgaaggatttgcagttcccggagttcgagtggtccgactatggtaatagtaataatgataataataatggtgtggacaacattatagagaacaatatgatgagcctgtgggaaattagtgactttagcagtttggatttgctgcttaatgatgagagttcttccacttttgggttgttttgaattcattcttaagaatatggtttcttttgtaaaagaatggaaactattggggtgggggaaacagaaaaacctaaatacccttcgttactctagtttttgagggatttgagagaacgtttttttacttgtgagaaatttagaaacaaaaataaagtttatttattttgtac

SEQ ID NO: 1060 - protein, 282 aa, Arabidopsis thaliana
  G677 Amino Acid Sequence
MGRQPCCDKVGLKKGPWTAEEDRKLINFILTNGQCCWRAVPKLSGLLRCGKSCRLRWTNYLRPDLKRGLLSDYEEKMVIDLHSQLGNRWSKIASHLPGRTDNEIKNHWNTHIKKKLRKMGIDPLTHKPLSIVEKEDEEPLKKLQNNTVPFQETMERPLENNIKNISRLEESLGDDQFMEINLEYGVEDVPLIETESLDLICSNSTMSSSTSTSSHSSNDSSFLKDLQFPEFEWSDYGNSNNDNNNGVDNIIENNMMSLWEISDFSSLDLLLNDESSSTFGLF

SEQ ID NO: 1061 - DNA, 925 bp, Arabidopsis thaliana
  G677 Genomic Sequence
tcaaaacaacccaaaagtggaagaactctcatcattaagcagcaaatccaaactgctaaagtcactaatttcccacaggctcatcatattgttctctataatgttgtccacaccattattattatcattattactattaccatagtcggaccactcgaactccgggaactgcaaatccttcaagaaactcgaatcattagaagaatgcgaagatgtggacgtggatgaagacattgttgaattgctgcagataaggtctaaagactctgtttcaataagagggacatcttcgacaccatactcaagatttatctccatgaattgatcatcacctaaagactcttcaagtcttgatatgttcttgatgttgttctctaaaggacgctccattgtttcttgaaaaggaactgtattattctgtagcttctttaagggttcttcgtcttctttttcgacgatagagagtggtttatgtgtaagaggatcaatccccattttcctcaacttcttcttgatgtgagtgttccaatgattcttgatttcgttgtctgttcttcctggtaaatgagaagctatctttgaccacctttacatacaaaaaacaaaatctcaaaaacagaacatatcgaaacttaaagcacaagtaagaaacgtttgttaacctgtttccaagctgggaatggagatcaatgaccatcttctcttcgtaatcagagagaagacctctcttaaggtctggtctaagatagttagtccaacgaagtctgcaactcttgccacacctaagaagaccagaaagcttaggaacagctctccaacaacattgtccattggtaaggatgaagtttatgagcttcctatcctcttctgcagtccatggtcctttcttcaaccctactttgtcacagcatggttgtctccccat

SEQ ID NO: 1062 - DNA, 925 bp, Arabidopsis thaliana; identical to SEQ ID NO: 1061
  G677 DNA sequence used for BLAST

SEQ ID NO: 1063 - DNA, 1043 bp, Arabidopsis thaliana
  misc_feature (1010)..(1010): n is a, c, g, or t
  misc_feature (1024)..(1024): n is a, c, g, or t
  misc_feature (1036)..(1036): n is a, c, g, or t
  G679 cDNA Sequence
ctaatctgtacggttcttatttcgaaagggtaaaaaccaaaagcgacgcaaagggcaaaatcggaaaaagtgttttatttatggccgccgttagtagttcgtcggagaccggagactgcggcgttacgggaaagagagatgagatcatgttgttcggagttagagtcgtggttgatccgatgagaaagtgtgtgagtttgaacaatctctctgattatgaaaagtcttctccggaggatgagatccctaagatagtcaccgccggagctggagatggtgaagataagaacgaaacggatgcgacggtgattgtcgctgacggttacgcctccgccaatgacgctgtccagatttcgtcttcttccggcgggaggaaacgaggggttccatggacagagaacgagcataagaggttcttgattgggttgcagaaagtaggaaaaggagattggaaaggaatatcaagaaactttgtgaagagtaggactcctactcaagtagctagtcatgctcagaaatacttcctccgacgaaccaacctcaaccgtcgccgaagaagatctagcctttttgatatcactactgagacggttacagaaatggccatggagcaagatcctactcaggagaactcaccactacctgaaaccaacatcagctctggacagcaagcgatgcaagtttttactgacgtggccgacaaaaactgagaatgcaccagagacatttcatctcaacgatccatatctggttccagtaaccttccaagcaaagccaacattcaatctaaacacagatgctgctccactttctctcaacctttgtctggcatcctcatttaatcttaacgagcaacccaactcaagacactcggctttcacgatgatgccaagcttcagcgatggagatagcaatagcagcatcatcagagttgcttagagcttaaacccaaggggaatctacaagaacctggttctttctttgggtctctggtggtgggaggactaagnagtacctattaggngttaacagattngaaaaaa

SEQ ID NO: 1064 - protein, 209 aa, Arabidopsis thaliana
  G679 Amino Acid Sequence
MAAVSSSSETGDCGVTGKRDEIMLFGVRVVVDPMRKCVSLNNLSDYEKSSPEDEIPKIVTAGAGDGEDKNETDATVIVADGYASANDAVQISSSSGGRKRGVPWTENEHKRFLIGLQKVGKGDWKGISRNFVKSRTPTQVASHAQKYFLRRTNLNRRRRRSSLFDITTETVTEMAMEQDPTQENSPLPETNISSGQQAMQVFTDVADKN

SEQ ID NO: 1065 - DNA, 1233 bp, Arabidopsis thaliana
  G679 DNA sequence used for BLAST
ttaaatgaggatgccagacaaaggttgagagaaagtggagcagcatctgtgtttagattgaatgttggctttgcttggaaggttactggaaccagatatggatcgttgagatgaaatgtctctggtgcattctcagtttttgtcggcacgtcagtaaaaacttgcatcgcttgctgtccagagctgatgttggtttcaggtagtggtgagttctcctgagtaggatcttgctccatggccatttctgtaacctgatcaaaccaatcacacctaactgtcacacacttaccattattgtttataaactacaacttaaaagatatatacccaattagaccaaaaatcattatgatacttctccatattactttgtctttaagttctaaagaagaaatactaaaaacctaagaaaggaaagagctttgagaaagcagagaacaccaaagaaagtaagaaagttaagttctatcaactaagctaaagtctagaccttttcattcacatatgatttagctaacataaaatgatttaggataagagtagagatttaccgtctcagtagtgatatcaaaaaggctagatcttcttcggcgacggttgaggttggttcgtcggaggaagtatttctgagcatgactagctacttgagtaggagtcctactcttcacaaagtttcttgatattcctttccaatctccttttcctactttctgcaacccaatcaagaacctcttatgctcgttctctgtccatggaacccctgttttgttcaacacaaacaaacaataatcaacgacaacgaatccatagctcaaaaccaatcaatcaccgacataaattccaacatgcatagattcaatcacgaattggataagattcaaattagagacattctaataatacaatcaatcagaatcctaagctcttatcagaatcagaaaaagagtagtacctcgtttcctcccgccggaagaagacgaaatctggacagcgtcattggcggaggcgtaaccgtcagcgacaatcaccgtcgcatccgtttcgttcttatcttcaccatctccagctccggcggtgactatcttagggatctcatcctccggagaagacttttcataatcagagagattgttcaaactcacacactttctcatcggatcaaccacgactctaactccgaacaacatgatctcatctctctttcccgtaacgccgcagtctccggtctccgac

SEQ ID NO: 1066 - DNA, 2526 bp, Arabidopsis thaliana; identical to SEQ ID NO: 68
  G680 cDNA Sequence

SEQ ID NO: 1067 - protein, 645 aa, Arabidopsis thaliana
  G680 Amino Acid Sequence
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 1068 - DNA, 3070 bp, Arabidopsis thaliana
  G680 Genomic Sequence
tcatgtagaagcttctccttccaatcgaagccttttgcagactttttcatcactttgattgtttatgttcccaacttggctctctttcacttccattgaacatctcttgtatggcttaaatcctgtctgtctcgttttaagactcttgcatgttccaacaccgatcattactactccttcttggtctgcagcacaagaatcctggcttttgaaattaggagccaatggcattgacgtgtcactttgttttctattcacattctctgccacttgaggaggcgaaaagctttgaggcaatctttctcttgcaaagagagcctgaaacgctatacgaccctgaaaatattttgatagtgttagttcccagaagaactctgcaatatccatgaatcattggtttttgttttacctcttcggagacttccttccacgaatcagtagttgcattgttgttgctgttgttgtctctcattttaatcttacggttatttaactcaataacatctggctgattctcatctgtctccttcacatcctctttatctttctccattttatctaatgcatcagtttctgcgtcactccctgaaggtgtatttgagccacaggatgagcggtccacaagatttttcttctgggcagtgtttgagtcatgcacagcggcagtaacaacaacctcctcaattttatcatcattggtttttgagtcggcatttagcttggttactccagtctcatctgaatcatcagatgatgaagctggagatttcgaagccaagttttgatcttgcagagctgtgttttgtttctcaaacggttgagtattttcaacggtatccatttcagtcattgctggagttggaactgcaacagttgagaatggaacacatgttattggagctggagcgcatacaggaagaagtccatgagaagcccaccaagcagttgcagcagctactgtagcagcggcaatggcagttatacttggaggagaagagctcattggggttgatgaatcaccagaattcccgacactcgcataaggccagaccgaagcagcgaatgtagctgcagcatgagctgcaggattctgtaggagagttgacataataagattggagaaagtagatgatatctggagaaacgaacggtaatcatcctgtgaatgacaagctggaaacgcttgatgagaagctgtagtagtagcagatgctgttgtagcttgaagatttgcgtgcccgtgagtttcttctctcataggatgaaacatgaagtcttgagataccatacctgagggatgattttgagggcattttgctatattcccgttcacaatatctgcgtggaaatgccaagggtagttttgcatgctgtgcacagtagtaccatcgttaccatctttgtctttgttcttcttgggaacatcttgaaccgcgttgtccacagttgaggtcttacttgtttcaatgtcgccacttacctgctaaaaatcagaatggaacaaataatttgtcatgcacttgaaagcattcatcagattcttcgactacaattttgtagctttcttagacttactttcgttggtaagggatacttgttcacagtagaaacacccgagcaattctcatcttgattttcttttccagttgatgttttctaaccagaaaataaaacataagaagtctatcacaagaccaccaaaatgataaaatgaagaagagaaagatcaggaataaacctcagagaacggcattttttccaaatccaagaacgcctgattcaactgtgaagaagaggccgatgaaacaagttttgcatcttttgctgatgatacttgagaggaagatgtaccgttgttcccaggctttcgaggataaggagtattgggttttcgtttaggacgaggaggcggaatttctatgtccaaagcttggcaaacagggatgcctttaacttcagcctctttctccaactgaaatgtgaaccaaaaactgtgagcttttccaaactggagatggaaaaatgcagctcagatgtgaaatcctgagattcatgaaattgaccacatcaccaaggttgaaaaaagtcttatactgacccgaatttttcggggtagagatgatagagttacttcatgtcctgtcctatagggcaaggaggtttggtttccatatggatggctaaaagaattcatgcaatcccattatttcatcgactttagtgaatatgggacaattgtgtcatccaaatgcaacgctagttatgttaatttggacctatcttatggtctcagagaagaaagctctctgtagagttttttctaacagtaagtttggacagaccaatctaatgttaagtttagttgaacagagtaaatgaaaaagataaaaaacgatcgagatgcaatcctcggaaccaaccaactctacttagcaaaacacactctacttagacgcctaatttctagttgaagcaattagagaaaaggaagaataagaagaaccttctatcatcttttccagacagtgacaggcaacttctaaacatagtcatagatcgatatgaaaaaatggtacctttacacaagataacgaaagtgttttaaaaagatctgaaaggatcatcaacttacctttgtgaagaacttttgtgcatgacttctgatctgaacagcagtctttgtcccaatatgttctgcacacaaaatgaaaagaaaagaaggaatctcccaatcaagaggagataaagacactcctaaacaaaggaatataaaatctcaaagagttcaaactaaacattcaaaagataaactttcgaccttcaattcgttgccaagctcttccataaagcctcaaggcttctagaaacctctcatgctcatcctcagtccatcgctctcgctgctttgttattgtatatggctttcttgcctaaacatttgaaaacccaaaagaaaatcaaatcttcacacaacaacagtccaaatctctcaaacaaaaaaacaccaatcttatttcattagtagtagtaccttagctaataattcttctccagatgtattagtatccat

SEQ ID NO: 1069 - DNA, 3070 bp, Arabidopsis thaliana; identical to SEQ ID NO: 1068
  G680 DNA sequence used for BLAST

SEQ ID NO: 1070 - DNA, 228 bp, Arabidopsis thaliana; identical to SEQ ID NO: 30
  G682 cDNA Sequence

SEQ ID NO: 1071 - protein, 75 aa, Arabidopsis thaliana
  G682 Amino Acid Sequence
MDNHRRTKQPKTNSIVTSSSEEVSSLEWEVVNMSQEEEDLVSRMHKLVGDRWELIAGRIPGRTAGEIERFWVMKN

SEQ ID NO: 1072 - DNA, 437 bp, Arabidopsis thaliana
  G682 Genomic Sequence
tcaatttttcatgacccaaaacctctcaatttctccagcggttcttcctgggatcctcccagctatcagttcccacctttcatcaaataataacacacaaaattcagcttttactatggtgttacaattaaattattttcctacgaaatagtattcattattagttaaaagatcaaacctgtcaccgacaagcttatgcattcgagagaccaaatcttcttcttcttgactcatgttcacaacttcccactcaagactactcacttctgttccttgtcatcaccaaaattcagatttctcattatatatagataagtataaaaaaacatggaaaaatgagaaaacgaaggtgtttaagttttcagcttaccttcagaagaagaagtaacgatggagttggtcttgggttgcttagtcctgcgatggttatccatgtc

SEQ ID NO: 1073 - DNA, 434 bp, Arabidopsis thaliana
  G682 DNA sequence used for BLAST
tcaatttttcatgacccaaaacctctcaatttctccagcggttcttcctgggatcctcccagctatcagttcccacctttcatcaaataataacacacaaaattcagcttttactatggtgttacaattaaattattttcctacgaaatagtattcattattagttaaaagatcaaacctgtcaccgacaagcttatgcattcgagagaccaaatcttcttcttcttgactcatgttcacaacttcccactcaagactactcacttctgttccttgtcatcaccaaaattcagatttctcattatatatagataagtataaaaaaacatggaaaaatgagaaaacgaaggtgtttaagttttcagcttaccttcagaagaagaagtaacgatggagttggtcttgggttgcttagtcctgcgatggttatccat

SEQ ID NO: 1074 - DNA, 1157 bp, Arabidopsis thaliana
  G699 cDNA Sequence
tcatgaagagactaagcagctcagattcaatgtgtggtctaatctccacttctacagatgaacagagtccaagagggtacggaagtaattaccaatctatgcttgaaggttacgatgaagatgctacactaatcgaggaatattccggcaaccaccaccacatgggtctatcggagaagaagagaagattaaaagttgaccaagtcaaagctcttgagaagaatttcgaacttgagaataaactcgaacctgagaggaaaactaaattagcacaagagcttggacttcaacctcgtcaagtagctgtttggtttcagaaccgtcgtgcacggtggaaaacaaaacagcttgaaaaagattacggtgttcttaagggtcaatacgattctctccgccacaatttcgattctctccgccgtgacaatgattcccttctccaagagattagtaaaatcaaagctaaggtaaacggtgaagaagataacaacaacaacaaagctattacggagggtgttaaggaagaggaagttcacaagacggattcgattccttcgtctcctctgcagtttctagaacattcctctggttttaactaccggcgaagcttcactgacctccgtgaccttctaccgaattccaccgttgtcgaggctggatcttccgatagttgcgattcaagcgccgttcttaacgacgaaacaagttctgataacggaagattgacgccgcctgtgacggttactggcgggagtttcttacagtttgtgaaaacagagcaaacagaggatcacgaggattttctaagcggtgaagaagcttgtggtttcttctccgatgaacagccgccgtcacttcattggtactctgcttcagatcattggacttgagaattgtttatcaaattggtgctctgtttagtctcaatgggaaaacagagaagagggcaaaggtggaataattgataaataaggattaaggatgaaggggattattaaattaaatccgcgggagaagttaattttgggtttaagattgtaatggctcttcatgtaattaacgatgtcgagaggggctttcacagaaataggaatcaatggggacactctgatatgaaaaaaaaaaaaaaaaaaaaaaaaaaaaaaaaaaaaaaaaaaaaa

SEQ ID NO: 1075 - protein, 294 aa, Arabidopsis thaliana
  G699 Amino Acid Sequence
MKRLSSSDSMCGLISTSTDEQSPRGYGSNYQSMLEGYDEDATLIEEYSGNHHHMGLSEKKRRLKVDQVKALEKNFELENKLEPERKTKLAQELGLQPRQVAVWFQNRRARWKTKQLEKDYGVLKGQYDSLRHNFDSLRRDNDSLLQEISKIKAKVNGEEDNNNNKAITEGVKEEEVHKTDSIPSSPLQFLEHSSGFNYRRSFTDLRDLLPNSTVVEAGSSDSCDSSAVLNDETSSDNGRLTPPVTVTGGSFLQFVKTEQTEDHEDFLSGEEACGFFSDEQPPSLHWYSASDHWT

SEQ ID NO: 1076 - DNA, 1168 bp, Arabidopsis thaliana
  G699 DNA sequence used for BLAST
tcaattattccacctttgccctcttctctgttttcccattgagactaaacagagcaccaatttgataaacaattctcaagtccaatgatctgaagcagagtaccaatgaagtgacggcggctgttcatcggagaagaaaccacaagcttcttcaccgcttagaaaatcctcgtgatcctctgtttgctctgttttcacaaactgtaagaaactcccgccagtaaccgtcacaggcggcgtcaatcttccgttatcagaacttgtttcgtcgttaagaacggcgcttgaatcgcaactatcggaagatccagcctcgacaacggtggaattcggtagaaggtcacggaggtcagtgaagcttcgccggtagttaaaaccagaggaatgttctagaaactgcagaggagacgaaggaatcgaatccgtcttgtgaacttcctcttccttaacaccctccgtaatagctttgttgttgttgttatcttcttcaccgtttaccttagctttgattttactaatctgcaaccaaaaactttaaaaatcaaacctttttgcattttcgtctctgaagtttcaatttttatggtttaaagtctctaatattgtacctcttggagaagggaatcattgtcacggcggagagaatcgaaattgtggcggagagaatcgtattgacccttaagaacaccgtaatctttttcaagctgttttgttttccaccgtgcacgacggttctgaaaccaaacagctacttgacgaggttgaagtccaagctcttgtgctaatttagttttcctctcaggttcgagtttattctcaagttcgaaattcttctcaagagctttgacttggtcaacttttaatcttctcttcttctccgatagacccatgtggtggtggttgccggaatattcctcgattagtgtagcatcttcatcgtaaccttcaagcatagattggtaattacttccgtaccctcttggactctgttcatctgttgtgtaaccaaatgaatcttgtcaataaaagaaacagtggaaagtgaagaaaggatcacatgggttttgtctgacattagcaaaaagtagaaagaacaaagatggtaataagaacctgtagaagtggagattagaccacacattgaatctgagctgcttagtctcttcat

SEQ ID NO: 1077 - DNA, 965 bp, Arabidopsis thaliana
  G713 cDNA Sequence
ggcacgagccttctctcttaatcaaaatcaagaaacttacaagatctggtgaaaaccatggaagaaggagattttttcaactgctgtttcagcgagattagtagtggcatgaccatgaataagaagaagatgaagaagagcaataaccaaaagaggtttaacgaggaacagatcaagtcacttgagcttatatttgagtctgagacgaggcttgagccgaggaagaaggttcaggtagctagagagctagggctgcaaccaagacaaatgactatatggtttcaaaacaagagggctcgatggaaaactaagcaacttgagaaagagtataacactcttagagccaattacaacaatttggcttcacaatttgaaatcatgaagaaagaaaagcaatctctggtctctgagctgcagagactaaacgaagagatgcaaaggcctaaagaagaaaagcatcatgagtgttgtggtgatcaaggactggctctaagcagcagcacagagtcgcataatggaaagagtgagccagaagggaggttagaccaagggagtgttctatgtaatgatggtgattacaacaacaacattaaaacagagtattttagggtccagggagagactgatcatgagctgatgaacattgtggagaaagctgatgatagttgcttgacatcttctgagaattggggaggtttcaattctgattctctcttagaccaatctagcagcaattaccctaactggtgggagttttggtcataaaagcatataagaaaaaaacagaacataagcgaagagaaagagtgtgaatagtttgtaaattatgtgttaagaaaataaatttagtttagtttaaatcttgtttcgatctatgtatctactatgttcaatactctttgtagctaattagtagcttataatgagactagaaaagttttgaagtcaaaaaaaaaaaaaaaaaa

SEQ ID NO: 1078 - protein, 235 aa, Arabidopsis thaliana
  G713 Amino Acid Sequence
MEEGDFFNCCFSEISSGMTMNKKKMKKSNNQKRFNEEQIKSLELIFESETRLEPRKKVQVARELGLQPRQMTIWFQNKRARWKTKQLEKEYNTLRANYNNLASQFEIMKKEKQSLVSELQRLNEEMQRPKEEKHHECCGDQGLALSSSTESHNGKSEPEGRLDQGSVLCNDGDYNNNIKTEYFRVQGETDHELMNIVEKADDSCLTSSENWGGFNSDSLLDQSSSNYPNWWEFWS

SEQ ID NO: 1079 - DNA, 894 bp, Arabidopsis thaliana
  G713 DNA sequence used for BLAST
ttatgaccaaaactcccaccagttagggtaattgctgctagattggtctaagagagaatcagaattgaaacctccccaattctcagaagatgtcaagcaactatcatcagctttctccacaatgttcatcagctcatgatcagtctcttcctcgaacccaaaatactctgttttaatgttgttgttgtaatcaccatcattacatagaacactcccttggtctaacctcccttctggctcactctttccattatgcgactctgtgctgctgcttagagccagtccttgatcaccacaacactcatgatgcttttcttctttaggcctttgcatctcttcgtttagtctctgcagctgcaaatagagattgattaatatcaaattaggcaaaatgatcgagaatttacatcccccaaaaaccaataaatgccaagactgtatttgctattttatactttataaaaaaaaaagatcattatcaattattgtttctatcactgttcaattaaagataaagatatcgatagaatcattatgtacctcagagaccagagattgcttttctttcttcatgatttcaaattgtgaagccaaattgttgtaattggctctaagagtgttatactctttctcaagttgcttagttttccatcgagccctcttgttttgaaaccatatagccacttgtcttggttgcagccctagctctctagctacctgaaccttcttcctcggctcaagcctcgtctcagactcaaatataagctcaagtgacttgatctgttcctcgctaaacctcttttggttattgctcttcttcatcttcttcttattcatggtcatgccactactaatctcgctgaaacagcagttgaaaaaatctccttcttccat

SEQ ID NO: 1080 - DNA, 951 bp, Arabidopsis thaliana
  misc_feature (948)..(948): n is a, c, g, or t
  G714 cDNA Sequence
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggctaaaaamwawagagaawmctagctnacg

SEQ ID NO: 1081 - protein, 217 aa, Arabidopsis thaliana
  G714 Amino Acid Sequence
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 1082 - DNA, 654 bp, Arabidopsis thaliana
  G714 Genomic Sequence
atggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaattag

SEQ ID NO: 1083 - DNA, 654 bp, Arabidopsis thaliana; identical to SEQ ID NO: 1082
  G714 DNA sequence used for BLAST

SEQ ID NO: 1084 - DNA, 1530 bp, Arabidopsis thaliana
  G718 cDNA Sequence
aagctttactctattgaagacgagatccttctctaatttacagattttggtggtcagtgtctgatggagtgtaatgcaaagccaccgtttcaatgggaattggaaaacttgatatcttttggcacttctacagctgaagttcctagaaagctaaaaccaatggagtgggaaattgatggatttgattgcacctctctgtattcttcaagctttgcctatgctggtagttcaggttctgatatagctcatgctttctctaaaagctcaaagtcaacttccattagctcttcatcagctgaagtaagaacacacaattttacatccgaaactggtgaaagtcttcctggagaatttgcaaaggggattgatacttctccaactcttgaactttcttttggctctggtgatccggttctcggtttaaagcttgctaaacgaacgtactttgaagacttttgggaagtggagaatgctaaaggtttgggacttcctgtgactctcgcttcatcttctgtttctcccgtgaagaaatcgaaatccattcctcagaccttacaaactcctcactgtcaagttgaaggctgtaatcttgatctttcatcagctaaagactatcatcggaaacataggatttgtgaaaaccattcaaagtttcctaaagtcgttgtgagtggcgtagagcgtcggttctgccaacaatgtagcaggttccactgtctctccgagtttgatgagaagaaacgtagctgtcgccgacctctctcagatcacaatgcaagacgtcgcaagccaaatcctggaaggacatatgatgggaaaccacaggtggattttgtatggaacagatttgcacttatccatccaagaagtgaggaaaagtttctatggcccagttcaaagcctgtaccatcaagagtcttaatgccgcagcctgcaaagaccgagatttccaataagctgttcaccgagcacagtagatttggattgttggaccccaaaacaaaatccgcaagagcggagttattcagtaaagaaaaggtcacaatctcttcacacatgggtgcttctcaagatcttgatggtgctctctctcttctgtcaaattcaacaacatgggtttcttcctctgaccaaccaagacgttttacccttgatcaccatccctcaagcaacctccaacccgtagctaaccggtctgcggctcaactcagttcagtgtccggctattggcagccggacccacccgcagttgaaggcccgaccgctctgcatagaaatggggcaggccagtttaatgaaaactacttcagcttgaaccagttttataactgaaagctgtatgcctttaaatcctatttaggatcaagcaagctagtgataagttaagataggagctgtgaaacttgcaagacaccaaatcctctcttatttctttgtccaaatattttcatgggttagagagctttgacaattgtctttaatatcaactttatcgtgttatacattaggattataaaaaaaaaaaaaaaa

SEQ ID NO: 1085 - protein, 422 aa, Arabidopsis thaliana
  G718 Amino Acid Sequence
MECNAKPPFQWELENLISFGTSTAEVPRKLKPMEWEIDGFDCTSLYSSSFAYAGSSGSDIAHAFSKSSKSTSISSSSAEVRTHNFTSETGESLPGEFAKGIDTSPTLELSFGSGDPVLGLKLAKRTYFEDFWEVENAKGLGLPVTLASSSVSPVKKSKSIPQTLQTPHCQVEGCNLDLSSAKDYHRKHRICENHSKFPKVVVSGVERRFCQQCSRFHCLSEFDEKKRSCRRPLSDHNARRRKPNPGRTYDGKPQVDFVWNRFALIHPRSEEKFLWPSSKPVPSRVLMPQPAKTEISNKLFTEHSRFGLLDPKTKSARAELFSKEKVTISSHMGASQDLDGALSLLSNSTTWVSSSDQPRRFTLDHHPSSNLQPVANRSAAQLSSVSGYWQPDPPAVEGPTALHRNGAGQFNENYFSLNQFYN

SEQ ID NO: 1086 - DNA, 1617 bp, Arabidopsis thaliana
  G718 Genomic Sequence
tcagttataaaactggttcaagctgaagtagttttcattaaactggcctaccccatttctatgcagagcggtcgggccttcaactgcgggtgggtccggctgccaatagccggaaactgaattgagttgagccgcagaccggtgagctacgggttggaggttgcttgagggatggtgatcaagggtaaaacgccttggttggtcagaggaagaaacccatgttgttgaatttgacagaagagagagagcaccatcaagatcttgagaagcacccatgtgtgaagagattgtgaccttttctaaaaatacgcataacataaagcatcatcaagatcatgaatacaacaaaaagatgagaccatgtacttgaaactcaagagaatacaaacctttactgaataactcggctcttgcggttttggttttggggtccaacaatccaaatctattgtgctcggtatcggaaatctcagtctttgcaggttgcggcattaacactcttgatggtacgtgcttcgaacttggccatataaacttttcctcacttcttggatggataagtgcaaatctgttccatacaaaatccacctgtggtttcccatctgcatacacagaatgacaaaagcatctccaattctccatcaatgagattgttgtgaacccccaaaactacatgaaatgatatctatcttgacaaaggaaactaactaaatgctataactgaactataggcaatttcagagttcatataaggataagaaataaatgattgttgtatataccatatgtccttccaggatttggcttgcgacgtcttgcattgtgatctgagagacgtcggcgacagctacgtttcttctcatcaaactcagagagacagtggaacctttggagaccaaaaaagttaagattttattaaggcttttgctaacagattaaacaaccttctctcttgagaaagactagcttttacctgctacattgttggcagaaccgacgctctacgccactcacaacgactttaggaaactttgaatgattttcacaaatcctatgtttccgatgatagtctttagctgatgaaagatcaagattacagccttcaacttgacagtgaggagtttgtaacctctgaggaatggatttcgatttcttcacgggagaaacagaagatgaagccagagtcactggaagtcccaaacctttagcattctccacttcccaaaagtcttcaaagtacgttcgtttaccaagctttaaaccgagaaccggatcaccagagccaaaagaaagttcaagacttggagaagtatcaatcccctttgcaaattctccaggaagactttcaccagtttcggatgtaaaattgtgtgttcttacttcagctgatgaagagctaatggaagttgactttgagcttttagagaaagcatgagctatatcagaacctgaactaccagcataggcaaagcttgaagaatacagagaggtgcaatcaaatccatcaatttcccactccattggttttagctttctaggaacttcagctgtagaagtgccaaaagatatcaagttttccaattcccattgaaacggtggctttgcattacactccat

SEQ ID NO: 1087 - DNA, 1617 bp, Arabidopsis thaliana; identical to SEQ ID NO: 1086
  G718 DNA sequence used for BLAST

SEQ ID NO: 1088 - DNA, 1087 bp, Arabidopsis thaliana
  G721 cDNA Sequence
cacattattcgagagaaatggaatcagccaatcactctctttcctccatatataaaatctagccaatattcacaaataataactacttccttcgttcttttccttaccaaaagatccacctcgaacctctctcctccgtcttcctccgcagccgccgtcactatcaccgcagctagaatgagagaagataatccaaattggttccttagatgggaagaagagcttccatctccagaagaactcatccctatctctcaaaccttaatcactcctcatctagctctcgctttccaaatcggaagtcctaatcatcatctcggatcaaagagaaccaccgcgatttatcaccagaagcttcaatcctccaccactccaacaactccaactccaactcctccaccgatgatgatgaattctgatttcggcggtggcgattccacggatcttggttcaggatcaataggaggagagccagcaagaacgttgaaacggccgcgtctagtgtggacgcctcagctacacaaacgtttcgtggatgcggttggacacttagggatcaaaaacgcagttccaaagactataatgcagcttatgagcgttgaaggattgactagagagaacgttgcgagtcatcttcagaaatatcgtctttaccttaggagaatgcaaggcgggaacggtaacggaatcactggaggacacgtcatcgtctctgattcggctactgatcggctatttgctagctcaccggttccagctcatttcttgagcccggattacttgatgccgccattagagcattcgtatatggggaaacatgtgattacgcagcaaaaccagtggttcgtaatctgaggtatgaagattcggaatatggtcatggtagtatgaagatgcttaagcacttccctgccggaaattaatgaaatatttgaattcttaacttcatttttatggaagtaataatgtttaaggtatgtggattatctctgtaatttgcatttgtcgtcaggatcaataatctattgttagtgtatattatttgttacgcgaacaatttaacctttgtatgatgttatcatttgaa

SEQ ID NO: 1089 - protein, 225 aa, Arabidopsis thaliana
  G721 Amino Acid Sequence
MREDNPNWFLRWEEELPSPEELIPISQTLITPHLALAFQIGSPNHHLGSKRTTAIYHQKLQSSTTPTTPTPTPPPMMMNSDFGGGDSTDLGSGSIGGEPARTLKRPRLVWTPQLHKRFVDAVGHLGIKNAVPKTIMQLMSVEGLTRENVASHLQKYRLYLRRMQGGNGNGITGGHVIVSDSATDRLFASSPVPAHFLSPDYLMPPLEHSYMGKHVITQQNQWFVI

SEQ ID NO: 1090 - DNA, 747 bp, Arabidopsis thaliana
  G721 Genomic Sequence
ttaatttccggcagggaagagcttaagcatcttcatactaccatgaccatattccgaatcttcatacctcagattacgaaccacttggttttgctgcgtaatcacatgtttccccatatacgaatgctctaatggcggcatcaagtaatccgggctcaagaaatgagctggaaccggtgagctagcaaatagccgatcagtagccgaatcagagacgatgacgtgtcctccagtgattccgttaccgttcccgccttgcattctcctaaggtaaagacgatatttctgaagatgactcgcaacgttctctctagtcaatccttcaacgctcataagctgcattatagtctttggaactgcgtttttgatccctaagtgtccaaccgcatccacgaaacgtttgtgtagctgaggcgtccacactagacgcggccgtttcaacgttcttgctggctctcctcctattgatcctgaaccaagatccgtggaatcgccaccgccgaaatcagaattcatcatcatcggtggaggagttggagttggagttgttggagtggtggaggattgaagcttctggtgataaatcgcggtggttctctttgatccgagatgatgattaggacttccgatttggaaagcgagagctagatgaggagtgattaaggtttgagagatagggatgagttcttctggagatggaagctcttcttcccatctaaggaaccaatttggattatcttctctcat

SEQ ID NO: 1091 - DNA, 747 bp, Arabidopsis thaliana; identical to SEQ ID NO: 1090
  G721 DNA sequence used for BLAST

SEQ ID NO: 1092 - DNA, 1384 bp, Arabidopsis thaliana
  G723 cDNA Sequence
atttttcaaaaaacctttagaattttcatttttttacgattccgatgttaactgtttctccggctccagtactcatcggaaacaactcaaaggatacttacatggcggcagatttcgcagattttacgacggaagacttgccggactttacgacggtcggggatttttccgatgatcttcttgatggaatcgattactacgacgatcttttcattggtttcgatggagacgatgttttgccggatttggagatagattcggagattcttggggaatattccggtagcggaagagatgaggaacaagaaatggagggtaacacttcgacggcatcggagacatcggagagagacgttggtgtgtgtaagcaagagggtggtggtggtggtgacggtggttttagggacaaaacggtgcgtcgaggcaaacgtaaagggaagaaaagtaaagattgtttatccgatgagaacgatattaagaaaaaacctaaggtggattggacgccggagttacaccggaaatttgtacaagcggtggagcaattaggggtagacaaggcggtgccgtctcgaatcttggaaattatgaacgttaaatctctcactcgtcacaacgttgctagccatcttcagaaatataggtcacatcggaaacatctactagcgcgtgaagcagaagctgccagctggaatctccggagacatgccacggtggcagtgcccggagtaggaggaggagggaagaagccgtggacagctcctgccttaggctatcctccacacgtggcaccaatgcatcatggtcacttcaggcctttgcacgtatggggtcatcctacgtggccaaaacacaagcctaatactccggcgtctgctcatcggacgtatccaatgccggccattgcggcggctccggcatcttggccaggtcatccaccgtactggcatcagcaaccactctatccacagggatatggtatggcatcatcgaatcattcaagcatcggtgttcccacaagacaattaggacccactaatcctcccatcgacattcatccctcgaatgagagcatagatgcagctattggggacgttatatcaaagccgtggctgccgcttcctttgggactgaaaccgccgtcggttgacggtgttatgacggagttacaacgtcaaggagtttctaatgttcctcctcttccttgagaaagatctccaaaatttgtcgaaatctcaaacttttaacttcatttttttggtatcttctatgtatttttgcaagggaaagacgataaatccttgttgcttgatcatatgtatttctctatatgagtgcatgtatcgaagttaagcaactttaatatatcgttataatcttcgataaa

SEQ ID NO: 1093 - protein, 386 aa, Arabidopsis thaliana
  G723 Amino Acid Sequence
MLTVSPAPVLIGNNSKDTYMAADFADFTTEDLPDFTTVGDFSDDLLDGIDYYDDLFIGFDGDDVLPDLEIDSEILGEYSGSGRDEEQEMEGNTSTASETSERDVGVCKQEGGGGGDGGFRDKTVRRGKRKGKKSKDCLSDENDIKKKPKVDWTPELHRKFVQAVEQLGVDKAVPSRILEIMNVKSLTRHNVASHLQKYRSHRKHLLAREAEAASWNLRRHATVAVPGVGGGGKKPWTAPALGYPPHVAPMHHGHFRPLHVWGHPTWPKHKPNTPASAHRTYPMPAIAAAPASWPGHPPYWHQQPLYPQGYGMASSNHSSIGVPTRQLGPTNPPIDIHPSNESIDAAIGDVISKPWLPLPLGLKPPSVDGVMTELQRQGVSNVPPLP

SEQ ID NO: 1094 - DNA, 2213 bp, Arabidopsis thaliana
  G723 Genomic Sequence
atgttaactgtttctccggctccagtactcatcggaaacaactcaaaggatacttacatggcggcagatttcgcagattttacgacggaagacttgccggactttacgacggtcggggatttttccgatgatcttcttgatggaatcgattactacgacgatcttttcattggtttcgatggagacgatgttttgccggatttggagatagattcggagattcttggggaatattccggtagcggaagagatgaggaacaagaaatggagggtaacacttcgacggcatcggagacatcggagagagacgttggtgtgtgtaagcaagagggtggtggtggtggtgacggtggttttagggacaaaacggtgcgtcgaggcaaacgtaaagggaagaaaagtaaagattgtttatccgatgagaacgatattaagaaaaaacctaaggtgtgtttatttcccaattatccatgttagattagtttattttttttcttctttaaaggtaaaaaatcccattaagaaatcaccaacctttttaaggatttcattaaaaaaacataaacttctagtgtttctgaatattttttttacaaagttagtgaattagtgtatttatcatatacacaattattattaagtttgataactggagtagatctaggaccaaaaccaagttttgtgtagtaggactatacaaatttgtgtgtttatttggactaaatatttttttttataaaactgtaagacaattttctataaaaaaaatgaattccttttttttcttttcatttattgattaattaatatattgttccggcaaatcaggtggattggacgccggagttacaccggaaatttgtacaagcggtggagcaattaggggtagacaaggcggtgccgtctcgaatcttggaaattatgaacgttaaatctctcactcgtcacaacgttgctagccatcttcaggtaaattttagactaaaactatacaaactaattttaacaggaattaatcaagtgctataacccctaacatagtaattacctaatttatagattacatgtttttccttcaaaattttttatgaaaagacaagtaaaatactaaccaactcagatttgtgtaataagattaatttgtgttgtgttcttcttgtaatgatagaaatataggtcacatcggaaacatctactagcgcgtgaagcagaagctgccagctggaatctccggagacatgccacggtggcagtgcccggagtaggaggaggagggaagaagccgtggacagctcctgccttaggctatcctccacacgtggcaccaatgcatcatggtcacttcaggcctttgcacgtatggggtcatcctacgtggccaaaacacaagcctaatactccggcgtctgctcatcggacgtatccaatgccggccattgcggcggctccggcatcttggccaggtcatccaccgtactggcatcagcaaccactctatccacaggtaataataattcatttgtaaaaatgttacatgtttttccattattagttgtatggttaaatcatgaaaaataatcgaaatgacataactaaatcagctttgttgaacaatcatgacactgcaaaaagctagtctttgtacactattggctttttaacacatgcaacatatataagtataaaacggaatcattgaattagattgtggttttgtctaacaacgcaattagtaaaagattgcaagatcatgaatcatttttatgtagacaactaataaagatttagagctatgaattatgtatggattttacaaaaacatatttctaatcatggtttatgtgtatatatgtgtagggatatggtatggcatcatcgaatcattcaagcatcggtgttcccacaagacaattaggacccactaatcctcccatcgacattcatcccgtgagtgcaccttttttggtttcaattttgtttattagattttgattatgacataacccaaaaaagttttcgaataaattttggataattaacaatatttcattacttgacggttgcagtcgaatgagagcatagatgcagctattggggacgttatatcaaagccgtggctgccgcttcctttgggactgaaaccgccgtcggttgacggtgttatgacggagttacaacgtcaaggagtttctaatgttcctcctcttccttga

SEQ ID NO: 1095 - DNA, 2213 bp, Arabidopsis thaliana; identical to SEQ ID NO: 1094
  G723 DNA sequence used for BLAST

SEQ ID NO: 1096 - DNA, 1221 bp, Arabidopsis thaliana; identical to SEQ ID NO: 109
  G725 cDNA Sequence

SEQ ID NO: 1097 - protein, 358 aa, Arabidopsis thaliana
  G725 Amino Acid Sequence
MFHAKKPSSMNGSYENRAMCVQGDSGLVLTTDPKPRLRWTVELHERFVDAVAQLGGPDKATPKTIMRVMGVKGLTLYHLKSHLQKFRLGKQPHKEYGDHSTKEGSRASAMDIQRNVASSSGMMSRNMNEMQMEVQRRLHEQLEVQRHLQLRIEAQGKYMQSILERACQTLAGENMAAATAAAAVGGGYKGNLGSSSLSAAVGPPPHPLSFPPFQDLNIYGNTTDQVLDHHNFHHQNIENHFTGNNAADTNIYLGKKRPNPNFGNDVRKGLLMWSDQDHDLSANQSIDDEHRIQIQMATHVSTDLDSLSEIYERKSGLSGDEGNNGGKLLERPSPRRSPLSPMMNPNGGLIQGRNSPFG

SEQ ID NO: 1098 - DNA, 1615 bp, Arabidopsis thaliana
  G725 Genomic Sequence
atgttccatgctaagaaaccttcaagtatgaatggttcatatgagaacagagctatgtgcgttcaaggcgattcaggccttgtcctcaccaccgaccctaaaccgcgtttgcgttggaccgtcgaactccacgagcgttttgtggacgccgtcgctcagctcggcggccccgacagtatgaacacacatacacaaatatatattcaatccatttaaccaattataaatgtgttttttcaaagtttttgatcatttctatttgcagaagcgaccccaaagacgattatgagagttatgggtgtgaagggtcttactctttaccacctaaagagccatcttcaggtatgtacacaaatatagattagggtttttttcttccttgcttttaattttctctcctctttatcttttctattctttttttcacttaataatataatataataatctaacaacttatttggatctatgggtgcagaaattcaggcttggaaagcagccgcacaaggagtacggagatcactccacaaaggaaggttcaagaggtgaccactcttcctttctctatcaaattagggtttttataaaaaagttacccataatatagatatgtattaatgtatatatatgttctttgatccgtcttcttctaattttttttaccgtacgtgtagcttctgccatggatattcagcgcaacgtagcttcttcttctggcatgatgagtcgcaacatgaatgagtaatattttaatcagatttcgttaattttctcaactttcattttaatatatattacagcaactcacaccaggttggtttgatcaggatgcaaatggaagtgcagagaaggttgcatgaacagctagaggtaattaattaacctatagatattctatgataactgcttgtacaaaatcaatttgtatcccataaatatagtaaatgatttcattcaatttttataggtgcaaagacatctgcaactgaggattgaagcacaaggaaagtacatgcaatctatcttggagagagcttgccaaaccctagccggtgagaacatggcagccgccaccgcagcagccgccgtcggaggaggatacaagggtaatctgggaagttcgagtctttcagcagcggtgggcccacctcctcatcctcttagtttcccgccgtttcaagacctaaacatctatggaaacacaaccgaccaagtcctcgaccatcacaacttccatcatcaaaacatagagaaccatttcacgggtaacaatgctgcagacaccaacatttacttggggaagaagcgacctaatcctaattttggtaacgatgtaaggaaaggactattgatgtggtctgatcaagatcacgatctttccgcaaaccaatcgatcgatgatgagcatagaattcagatacagatggctacacatgtctccacggatttggattctttgtcggagatctacgaaaggaaatcaggtttatcaggtgatgaagggaataatggtgggaaattactggaaaggccatcgcctaggagatcaccattgagtcctatgatgaaccctaatggtggattaatacaaggaagaaactcgccatttgggtga

SEQ ID NO: 1099 - DNA, 1615 bp, Arabidopsis thaliana; identical to SEQ ID NO: 1098
  G725 DNA sequence used for BLAST

SEQ ID NO: 1100 - DNA, 1239 bp, Arabidopsis thaliana
  G726 cDNA Sequence
gaagactggaatttttttgaggaggactctgctccatcgccgcccgccctgtaacccaccggactcagtaaactagtctgtaacacaatatcttctatttcagataagatttagcttggagaagagcaagttccgaaaatggaggggcgtcgtgtatagatccaccacccacagccctgatggaagcagacaacggaggccccaattctagtcatgcatccaaacaacgtctgcgttggacgcatgagctacatgaacgcttcgttgatgccgttgctcaacttggtggccctgatagagctacacccaaaggcgttcttagagtgatgggtgtacaaggcttaactatatatcatgtcaagagtcacttacagaaatatcgacttgcaaagtatcttccagattcgtcttctgaagggaaaaaaactgataagaaagaatctggagatatgctctctgggttggacggctcgtcgggaatgcagataactgaagccctcaagttgcagatggaagttcagaaacgattgcacgagcaactagaagtgcaaagacagctgcaactacggatagaagcacaaggaaagtacttgaagaagataattgaagagcaacaacgactcagtggagtactcggcgaaccctcagccccagtaacgggcgattcagatcctgcaacccctgccccaacatctgagtctcctcttcaagacaagtctggcaaggactgtggaccagacaaaagtctctcagttgacgagtctctctcatcttaccgggagcctttaacaccagactcagggtgtaacattgggtctccagatgagagcacaggagaggagagattatcaaagaagcctcgattggtgagaggtgcagctggttatacacctgatattgtagtgggtcacccaatactagaatcaggcttgaacacttcttaccatcagtcagaccatgtcctcgcctttgaccagccatctacatcactgcttggggccgaagaacagttggataaggtttcaggagataatctttgagttgttgagtgtaccacatgtagtgttgtttatcctaatccttattagttaggagtttcctctaataatgtgatcacaagtcgttaattctctaggcactatcacgagcatgaagaatgaatatgtctgtgttgtgctgtaatttggtagacacaaaacaaaattactcttattcccaaaaaaaaaaaaaaaaaaaaaa

SEQ ID NO: 1101 - protein, 286 aa, Arabidopsis thaliana
  G726 Amino Acid Sequence
MEADNGGPNSSHASKQRLRWTHELHERFVDAVAQLGGPDRATPKGVLRVMGVQGLTIYHVKSHLQKYRLAKYLPDSSSEGKKTDKKESGDMLSGLDGSSGMQITEALKLQMEVQKRLHEQLEVQRQLQLRIEAQGKYLKKIIEEQQRLSGVLGEPSAPVTGDSDPATPAPTSESPLQDKSGKDCGPDKSLSVDESLSSYREPLTPDSGCNIGSPDESTGEERLSKKPRLVRGAAGYTPDIVVGHPILESGLNTSYHQSDHVLAFDQPSTSLLGAEEQLDKVSGDNL

SEQ ID NO: 1102 - DNA, 1447 bp, Arabidopsis thaliana
  G726 DNA sequence used for BLAST
tcaaagattatctcctgaaaccttatccaactgttcttcggccccaagcagtgatgtagatggctggtcaaaggcgaggacatggtctgactgatggtaagaagtgttcaagcctgattctagtattgggtgacccactacaatatcaggtgtataaccagctgcacctctcaccaatcgaggcttctttgataatctctcctctcctgtgctctcatctggagacccaatgttacaccctgagtctggtgttaaaggctcccggtaagatgagagagactcgtcaactgagagacttttgtctggtccacagtccttgccagacttgtcttgaagaggagactcagatgttggggcaggggttgcaggatctgaatcgcccgttactggggctgagggttcgccgagtactccactgagtcgttgttgctcttcaattatcttcttcaagtactttccttgtgcttctatccgtagttgcagctgtctttgcacctaagaaaaaatcacatcaaagaataatgtcatatgtaatgcaaaattcagtgctacactgaaaatcctactaattgtttcgttgttgcttgtctttcttaagtaggaatggtgaagcatacttctagttgctcgtgtaatcgtttctgaacttccatctgcaacttgagggcttcagttatctgcattcccctgtaatctcgaaacgatattgatcacttaatctgcggcgcgaggtaatatatatatagcatcacaaatcaagctcaaagagggaaatttcacgtacgacgagccgtccaacccagagagcatatctccagattctttcttatcagtttttttccctgaaaattgaaaaaaccagttttcaggtatataggaaactggtagaatgagaaagaagatgaagaaaatcaatgtccacactaccttcagaagacgaatctggaagatactttgcaagtcgatatttctgactcaaaatacacaaatgcaaaaatcagcaagggtaagagaaagagagacgagacaagatgccacacagtttgagaatacctgtaagtgactcttgacatgatatatagttaagccttgtacacccatcactctaagaacgcctttgggtgtagctcctttggaaatcaaaggaagaaaaatgtttaggaaccctaagcaaacagacgataggctttccctctcatggatagtagtaaagcatacaagaagagcaatttgattatattggtgtgcatattattaccacagatattgatgaggaaaacatgagttactaaatttaccatagactatacaagaaaaaaggaaacttactatcagggccaccaagttgagcaacggcatcaacgaagcgttcatgtagctcatgcgtccaacgcagacgttgtttggatgcatgactagaattggggcctccgttgtctgcttccat

SEQ ID NO: 1103 - DNA, 2007 bp, Arabidopsis thaliana; identical to SEQ ID NO: 46
  G727 cDNA Sequence

SEQ ID NO: 1104 - protein, 644 aa, Arabidopsis thaliana
  G727 Amino Acid Sequence
MVNPGHGRGPDSGTAAGGSNSDPFPANLRVLVVDDDPTCLMILERMLMTCLYREQRAHCLCFGRTKNGFDIVISDVHMPDMDGFKLLEHVGLEMDLPVINLNVLKPLVIVMSADDSKSVVLKGVTHGAVDYLIKPVRIEALKNIWQHVVRKKRNEWNVSEHSGGSIEDTGGDRDRQQQHREDADNNSSSVNEGNGRSSRKRKEEEVDDQGDDKEDSSSLKKPRVVWSVELHQQFVAAVNQLGVDSELKTCLLMHLCVSIGNIVEFQKYRIYLRRLGGVSQHQGNMNHSFMTGQDQSFGPLSSLNGFDLQSLAVTGQLPPQSLAQLQAAGLGRPTLAKPGMSVSPLVDQRSIFNFENPKIRFGDGHGQTMNNGNLLHGVPTGSHMRLRPGQNVQSSGMMLPVADQLPRGGPSMLPSLGQQPILSSSVSRRSDLTGALAVRNSIPETNSRVLPTTHSVFNNFPADLPRSSFPLASAPGISVPVSVSYQEEVNSSDAKGGSSAATAGFGNPSYDIFNDFPQHQQHNKNISNKLNDWDLRNMGLVFSSNQDAATATATAAFSTSEAYSSSSTQRKRRETDATVVGEHGQNLQSPSRNLYHLNHVFMDGGSVRVKSERVAETVTCPPANTLFHEQYNQEDLMSAFLKQV

SEQ ID NO: 1105 - DNA, 2658 bp, Arabidopsis thaliana
  G727 Genomic Sequence
atggtaaatccgggtcacggaagaggacccgattcgggtactgctgctggtgggtcaaactccgacccgtttcctgcgaatcttcgagttcttgtcgttgatgatgatccaacttgtctcatgatcttagagaggatgcttatgacttgtctctacagaggtaaaattcaatcaaaatttcgttttaatattaatctaaaattttattaatttacaaaggtttcatggtgaaattatgacccaatttgtgaaaatttattgtaattttggtggttaactatggattttaattacggtggttgactctgccaaaaatagtaaacagagcttatggaattgactagaagttttcattgactgttgaatgaatcactgttagattcagatatatatacatcgcttagttctctgttctgttctaatattgtgatctgcttaaagattctccttttgaggtttattttcaatagatcttttagttctcaagaaaagtgtgattcaaatttcttaaattttgttcaaaggttttaagagttagtttgagattctggtatttattttgatccagttctgttttcgattattttcaaaattttgttttttgatgctttttgactctgattctgttattacagtaactaaatgtaacagagcagagagcgcattgtctctgcttcggaagaacaaagaatggttttgatattgtcattagtgatgttcatatgcctgacatggatggtttcaagctccttgaacacgttggtttagagatggatttacctgttatcagtacgtatcttaatcgctaaaaacttattattaactctaattcgttttcttgagatctgaatgttttgaaacctttggttatagtgatgtctgcggatgattcgaagagcgttgtgttgaaaggagtgactcacggtgcagttgattacctcatcaaaccggtacgtattgaggctttgaagaatatatggcaacatgtggtgcggaagaagcgtaacgagtggaatgtttctgaacattctggaggaagtattgaagatactggcggtgacagggacaggcagcagcagcatagggaggatgctgataacaactcgtcttcagttaatgaagggaacgggaggagctcgaggaagcggaaggaagaggaagtagatgatcaaggggatgataaggaagactcatcgagtttaaagaaaccacgcgtggtttggtctgttgaattgcatcagcagtttgttgctgctgtgaatcagctaggcgttgacagtgagttaaaaacttgcttgcttatgcatttgtgtgtgtcgatgtttgttttcttgtctaatctttaccgtattggggcattcaatgcagaagctgttcctaagaagatcttagagatgatgaatgtacccggctaacgcgagaaaacgtagccagtcacctccaggtatatatgtgatcgaatagtattacattttttcattgttgatgtgttctaacagtggtaacattgtggaattccagaagtatcggatatatctgagacggcttggaggagtatcgcaacaccaaggaaatatgaaccattcgtttatgactggtcaagatcagagttttggacctctttcttcgttgaatggatttgatcttcaatctttagctgttactggtcagctccctcctcagagccttgcacagcttcaagcagctggtcttggccggcctacactcgctaaaccagggatgtcggtttctccccttgtagatcagagaagcatcttcaactttgaaaacccaaaaataagatttggagacggacatggtcagacgatgaacaatggaaatttgcttcatggtgtcccaacgggtagtcacatgcgtctgcgtcctggacagaatgttcagagcagcggaatgatgttgccagtagcagaccagctacctcgaggaggaccatcgatgctaccatccctcgggcaacagccgatattgtcaagcagcgtttcaagaagaagcgatctcactggtgcgctggcggttagaaacagtatccccgagaccaacagcagagtgttaccaactactcactcggtcttcaataacttccccgcggatctacctcgcagcagcttcccgttggcaagtgccccagggatttcagttccagtatcagtttcttaccaagaagaggtcaacagctcggatgcaaaaggaggttcatcagctgctactgctggatttggtaacccaagctacgacatatttaacgattttccgcagcaccaacagcacaacaagaacatcagcaataaactaaacgattgggatctgcggaatatgggattggtcttcagttccaatcaggacgcagcaactgcaaccgcaaccgcagcattttccacttcggaagcatactcttcgtcttctacgcagagaaaaagacgggaaacggacgcaacagttgtgggtgagcatgggcagaacctgcagtcaccgagccggaatctgtatcatctgaaccacgtttttatggacggtggttcagtcagagtgaagtcagaaagagtggcggagacagtgacttgtcctccagcaaatacattgtttcacgagcagtataatcaagaagatctgatgagcgcatttctcaaacaggtttga

SEQ ID NO: 1106 - DNA, 2658 bp, Arabidopsis thaliana; identical to SEQ ID NO: 1105
  G727 DNA sequence used for BLAST

SEQ ID NO: 1107 - DNA, 1760 bp, Arabidopsis thaliana
  G729 cDNA Sequence
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 1108 - protein, 403 aa, Arabidopsis thaliana
  G729 Amino Acid Sequence
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 1109 - DNA, 3728 bp, Arabidopsis thaliana
  G729 Genomic Sequence
tcatttctcgtgccaatctggtctgcctaatgtaaactccaaacttggattttcacaactaagatttccacacctctttgcttgatcattcgacctttgctcctgccaattttaactttatattagattaaaggacaaaaaaaacactaagaaaggcaatatctatctatacaaatatgattagatgggaattatcagaacctgattttgaatgctggatctttgataatgagagatcattgatgttgatgaagttctgatcattgtatctatgtcgcttgagcagttattacttaatggccatgtctctctattttatgatttaagaaaagaaagaaaacaaattaaggacaaattgtatttattgatgtatagatgccctaaaaataaaataaaaatcactacacacaaattgcgtttttttgcaacttgctatatgaccacaatctacatgtcatacttatgaagcaaaattcgtttatcctagtcttcctagatgaatcttaagaacccaaaccaaattataattaaaaaaaaaaacttggtacatataattaaagttcatcagccataaaccctaaccaatttcatctcattgtaaccaaaaccatcactcaaattttttccccttaaactgaacgaaaacaaacttaaaatatcatctaaaaactatttttgttagaagaaaatggatagatgtgggataaaccaaacaattgtcgtatgaattacttggtaggaagtaggaacaattaggtgagagaaccctaaaccctatctcaaatttcgtcaatcttattcttacctaatgtttatatatacttatcgtgtgtataatacatgtacgtatatacgtaaacgtaccgtgaagagttactccaacgaggttgtgtggaagaaatgtcagtttcttgatgaagagaagtatcatcagattgtgccctttgatccgtcgatgattgatgatgaacttcgtttccatttatgcccatttcttcttctcctgacccatctgaaattttattttaactttttatcaagtttcgttgtctcaaatcaatcacttataccctataaggaatctcatttaaaactgaacgattcttgtaagcttttttgtaaaagacaatgcagtgaagaaattgtttttcttaaaaaataatttcagcatttcgtgttgaccaacctaatatgtgtctcaaaaaatagttttacagactcgaaaattgtgccaaataaacttttaattggttaaagaaaatccatatgaaacaagtggtttttctttattcttaattcatgaactttgcttggatatgagtttacacttcacacgttttaaatttaatcttttactcgatttttttttcttagagaacatcaatattggggatatatgtttgtttggtttgctttgaactttgaccactcaactttagggttcaatcaaaggaaggataaaagccttgagcttgaccaatatcttagggctcgttttttattattttggggaaagggaatagtagaaatagtagaatcaaatagtaaaaataacagaaataatttcacgtcattatatctctacatacatacaaatatcgaatcacagcttcaaattctgattgagaactaatttcttataaatattgtagtcaaaaaaagctataatagtgattatattggacctccatttctataaaattctggtggagaatcctaagctttattgtatatctgtcttatgttattttttggtgaattgtatatctttcttattaaaagccagtaccatttctttagcatatataaagctgaaaaaagctatactaaagaaatgtgaatatgcataacattatatgtgtgtgtgtgtgtaaaggaatcacacgtacctgatgaagcagcaggcttgttagtggtcttaacagttcgatacatctgcaaaaaaaaaaaaattaaaggcatgatgagagctctaaaactagaataaaccataaatccaattaaagacacaggaaaaaaccaaaataaatatcggacaaaagatactgataaactaaatagatttatttttgtataatgtgatacagaattacagatgacaaactggagagatatatgcagacacatatgaactttatattattaaataaataatatatgtagtacatatgtgtggttttctgggtttgtcttggaactgatgatgtatatataattaattatttatgattttaagaccacgaggttgatgtctgaaagaaggttgagtaatagaaagattgtattattatcattgagtaatgatgactacttttgtcccctcttcctaatttaaaaaagaaaaaatgaattataatccaaaataacttctatctatcatctcaattctccattgtttaataattctctgaaaggtttcagtcacttaaagctataactactctctctttttctctctttaaattcattcaactgcttcaattttcttggcaattgtgccatctcttccaaaatatgactaaacttaaagcaaagacaaaacaagaaaataaaagtaacacatcagaattggagctctattcattgctctgatgatatatacgtacacaaaaaccttgtttcttgattcagctgtttttgtgcaaaacgcaaaggagaagagagtgacatgatggtgatgaaaactatgaaatatccctaattatagaaaatcttgattggtaacgaactaactcgactagattaaacctaaattaacaaataaaaattgattctttgttgtgtctaatttaatttcaaatagagtatagattatacctgcaaatggctcttcacatgtgctaaagttaagtcttttacatccatgagctcaagaaccgactttggagttgctcctagaatcacaacaacaacaagaataaaagatttaagactttgagaataaagtgaagaaaaatgggaatgatcattagaatgtgattatgatataaatgtgtactttcatggccgcctagaagctcaacagcgtgaacaaaccgcgcgtggaggctactagtccaacgcatccttggagctctcatgcttcgctttgtcggcatcttaggcaagaatcttgatctgatcatcccatgatgatgatggttatggtgatgaggagaagacgaatctgaagatccaacgactccatactgattatgatgatgatgatgatgcaaaggaacacctttaagcctcggggaagattgtaatgatcggtaagcgttgttgtagccggaagatgagtttaagattgagatttgatccatgtctcctcctccaagagaaggtaatgaagagttttgttggtggaaagggaatgaacggttgtgatagaccgggatgcctctaattggacggtggagattactaatctcggattcatcgaccctttgatgaacaccattgatgatagggttgttgtaatgctgctgatgaggaagattaagggttcttcgatcaggacaatggaagattcttgctgttggatggttatgatgagataaagagagttcaaagttggacgatcggttgttgttttcgagttgggaggatcttcttgaagattctttagaagattcattgtgatggtattgatgaatatctgggagactgatgtggagagatagatcagggagagtagttgttgtgtttgttttggttttctctagaaaaacaccttccatagacat

SEQ ID NO: 1110 - DNA, 3728 bp, Arabidopsis thaliana; identical to SEQ ID NO: 1109
  G729 DNA sequence used for BLAST

SEQ ID NO: 1111 - DNA, 1001 bp, Arabidopsis thaliana
  G731 cDNA Sequence
cttctttcttgtgtgttcacattcaaagaaaatggataatcacacagctaaagacattggtatgaagagaagtgcttctgagctggctctacaagagtatctcactacaagccctctagacccttgtttcgacctcatgaaccgggattacacttgtgagttaagagatagtcttttgtggtctgagggattgtttccggctggaccttttcgcgatgcacagtcctcaagctgcgagaatctgtcagctgatagtccagtgtcagccaataaacctgaggtaagaggaggagttaggagaaccacaagtggatcttctcatgttaactctgatgacgaagatgccgagacagaagcagggcaatctgaaatgactaatgatcccaatgatctgaaacgtattagaaggatgaactcaaacagggaatcagcaaagaggtcgaggagaaggaagcaagagtacttggtagatcttgagactcaggttgattctttgaaaggcgataactcaacactgtacaagcagctcatagacgcaacacaacagtttcgtagcgctggaacaaataacagagttctcaaatcagatgttgaaactctgagagtcaaggtgaaactagcagaagatttggtagcgagagggtcactcactagcagcttgaatcaacttctacaaactcatctaagtccaccatcacactccatcagcagtctgcactacacgggaaatacctcgcccgccattacagtccacagtgaccaatctttgttccctggaatgacactttctggacagaactcaagccctggacttggtaatgtatccagtgaagctgttagctgcgtctcagacatctggccatgactctctttcttcagaacatgtaatgatcactcagcgaatttcctgtatgtgtttcgctatagaactagaaacatataatgaaagcagcatgttcgttaaataaactcaagtttcgtcaacaaaaaaaaaaaaaaaa

SEQ ID NO: 1112 - protein, 267 aa, Arabidopsis thaliana
  G731 Amino Acid Sequence
MKRSASELALQEYLTTSPLDPCFDLMNRDYTCELRDSLLWSEGLFPAGPFRDAQSSSCENLSADSPVSANKPEVRGGVRRTTSGSSHVNSDDEDAETEAGQSEMTNDPNDLKRIRRMNSNRESAKRSRRRKQEYLVDLETQVDSLKGDNSTLYKQLIDATQQFRSAGTNNRVLKSDVETLRVKVKLAEDLVARGSLTSSLNQLLQTHLSPPSHSISSLHYTGNTSPAITVHSDQSLFPGMTLSGQNSSPGLGNVSSEAVSCVSDIWP

SEQ ID NO: 1113 - DNA, 1283 bp, Arabidopsis thaliana
  G731 Genomic Sequence
atggataatcacacagctaaagacattggtatgaagagaagtgcttctgagctggctctacaagagtatctcactacaagccctctagacccttgtttcgacctcatgaaccgggttagtccttttgttgtctctcttattcgtatcattgttgcttgtgtctatatcaagatccagagatattgtagtaattaagagtctagtttcttttggttgtaggattacacttgtgagttaagagatagtcttttgtggtctgagggattgtttccggctggaccttttcgcgatgcacagtcctcaatctgcggtatgtgcatgtctctttgatttgactccatgtaagtaataagtgttgttgcagttgatattaatgttcactacttgtgtggctcttatctacaaagagaatctgtcagctgatagtccagtgtcagccaataaacctgaggtaagaggaggagttaggagaaccacaagtggatcttctcatgttaactctgatgacgaagatgccgagacagaagcagggcaatctgaaatgactaatgatcccaatgatctgaaacgtattagaaggtatgttaggtaccaataaaaaagttagatgtaaaacactgagatagagaatcaccaattcttcttaatctttttctgtgatgtgaattcaggatgaactcaaacagggaatcagcaaagaggtcgaggagaaggaagcaagagtacttggtagatcttgagactcaggtaaggttaacaaatagcttgttggatgatttgtatcagagagtaatgttttaatggtgaccttgtgttttcttcaaggttgattctttgaaaggcgataactcaacactgtacaagcagctcatagacgcaacacaacagtttcgtagcgctggaacaaataacagagttctcaaatcagatgttgaaactctgagagtcaaggtatcatctatcacttgctcttttcaatttgggaaagtaataaccggaatgtgctaagttaagtaaattctatataggtgaaactagcagaagatttggtagcgagagggtcactcactagcagcttgaatcaacttctacaaactcatctaagtccaccatcacactccatcagcagtctgcactacacgggaaatacctcgcccgccattacagtccacagtgaccaatctttgttccctggaatgacactttctggacagaactcaagccctggacttggtaatgtatccagtgaagctgttagctgcgtctcagacatctggccatga

SEQ ID NO: 1114 - DNA, 1283 bp, Arabidopsis thaliana
  G731 DNA sequence used for BLAST
tcatggccagatgtctgagacgcagctaacagcttcactggatacattaccaagtccagggcttgagttctgtccagaaagtgtcattccagggaacaaagattggtcactgtggactgtaatggcgggcgaggtatttcccgtgtagtgcagactgctgatggagtgtgatggtggacttagatgagtttgtagaagttgattcaagctgctagtgagtgaccctctcgctaccaaatcttctgctagtttcacctatatagaatttacttaacttagcacattccggttattactttcccaaattgaaaagagcaagtgatagatgataccttgactctcagagtttcaacatctgatttgagaactctgttatttgttccagcgctacgaaactgttgtgttgcgtctatgagctgcttgtacagtgttgagttatcgcctttcaaagaatcaaccttgaagaaaacacaaggtcaccattaaaacattactctctgatacaaatcatccaacaagctatttgttaaccttacctgagtctcaagatctaccaagtactcttgcttccttctcctcgacctctttgctgattccctgtttgagttcatcctgaattcacatcacagaaaaagattaagaagaattggtgattctctatctcagtgttttacatctaacttttttattggtacctaacataccttctaatacgtttcagatcattgggatcattagtcatttcagattgccctgcttctgtctcggcatcttcgtcatcagagttaacatgagaagatccacttgtggttctcctaactcctcctcttacctcaggtttattggctgacactggactatcagctgacagattctctttgtagataagagccacacaagtagtgaacattaatatcaactgcaacaacacttattacttacatggagtcaaatcaaagagacatgcacataccgcagattgaggactgtgcatcgcgaaaaggtccagccggaaacaatccctcagaccacaaaagactatctcttaactcacaagtgtaatcctacaaccaaaagaaactagactcttaattactacaatatctctggatcttgatatagacacaagcaacaatgatacgaataagagagacaacaaaaggactaacccggttcatgaggtcgaaacaagggtctagagggcttgtagtgagatactcttgtagagccagctcagaagcacttctcttcataccaatgtctttagctgtgtgattatccat

SEQ ID NO: 1115 - DNA, 834 bp, Arabidopsis thaliana; identical to SEQ ID NO: 47
  G732 cDNA Sequence

SEQ ID NO: 1116 - protein, 171 aa, Arabidopsis thaliana
  G732 Amino Acid Sequence
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 1117 - DNA, 516 bp, Arabidopsis thaliana
  G732 Genomic Sequence
atggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattga

SEQ ID NO: 1118 - DNA, 516 bp, Arabidopsis thaliana; identical to SEQ ID NO: 1117
  G732 DNA sequence used for BLAST

SEQ ID NO: 1119 - DNA, 1060 bp, Arabidopsis thaliana
  G735 cDNA Sequence
acaaattacaaaagagaaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaaactaatatgaaccctactaatgttaaacgcgttaaaaggatgctctctaatagagaatcagctagacggtccagaagaagaaagcaagcacacttgagtgagctagagacacaagtttcacagcttcgtgtagagaattcaaaactcatgaagggtctcactgatgtaactcaaacattcaatgatgcatctgtagaaaacagagttttaaaagccaatattgagacactacgagcaaaggtgaaaatggctgaagagacagtgaagagactcactggctttaacccaatgttccacaatatgcctcagattgtttcaactgtctctcttccttcagagacatcaaattctccagacactacaagcagccaagtgactacaccagagatcattagctcggggaacaaaggcaaggccttgatagggtgcaagatgaacagaacagcttcgatgcgtagtgttgagagcttggaacatctgcagaaacgtattcgaagcgttggggatcagtagctgttaaagaagaatcttgatttgtaacattaatcttaagacatatgttaaagacaaaatgttgtatgtttttggcggccgcgaattcctgcag

SEQ ID NO: 1120 - protein, 314 aa, Arabidopsis thaliana
  G735 Amino Acid Sequence
MEKVFSDEEISGNHHWSVNGMTSLNRSASEWAFNRFIQESSAAADDGESTTACGVSVSSPPNVPVDSEEYRAFLKSKLNLACAAVAMKRGTFIKPQDTSGRSDNGGANESEQASLASSKATPMMSSAITSGSELSGDEEEADGETNMNPTNVKRVKRMLSNRESARRSRRRKQAHLSELETQVSQLRVENSKLMKGLTDVTQTFNDASVENRVLKANIETLRAKVKMAEETVKRLTGFNPMFHNMPQIVSTVSLPSETSNSPDTTSSQVTTPEIISSGNKGKALIGCKMNRTASMRSVESLEHLQKRIRSVGDQ

SEQ ID NO: 1121 - DNA, 1500 bp, Arabidopsis thaliana
  G735 DNA sequence used for BLAST
ctactgatccccaacgcttcgaatacgtttctgcagatgttccaagctctcaactctacgcatcgaagctgttctgttcatcttgcaccctatcaaggccttgcctttgttccccgagctaatgatctctggtgtagtcacttggctgcttgtagtgtctggagaatttgatgtctctgaaggaagagagacagttgaaacaatctgaggcatattgtggaacattgggttaaagccagtgagtctcttcactgtctcttcagccattttcacctgccaaaaacaaacatgcttcaatagcgagttttggtagacagagagataaaagaaagtattttacctttgctcgtagtgtctcaatattggcttttaaaactctgttttctacagatgcatcattgaatgtttgagttacatcagtgagacccttcatgagttttgaattctctacacgaagctgtgaaacctacacgaaatggagattgtcgcacaagtgagctaaacaaagttaaaggagaaagaataagaacgctgcgagagtaacatacttgtgtctctagctcactcaagtgtgcttgctttcttcttctggaccgtctagctgattctctattagagagcatcctataacaaacaaattcacgttcatgttcatgttcaagtccaagaaaggatgtaaatttgttaccttttaacgcgtttaacattagtagggttcatattagtttcaccatcagcttcttcttcatcaccagagagctcagatccacttgttatagcactgctcatcattggtgtagctgcatacagattggtccattagcatttacaagaaatcttgaaaacaaacacaacaactatcaataacatcttaaaaggcttatcatagatgtattgtaaaacctttggaagaagcaagagaggcttgttctgattcattggctccaccattgtcagatctaccagaagtatcctgaggtttgatgaaagttccctatcaaattttcaatattaacaccacaaaatcaattaactaatgcaaattataatctcaaggaagataatggcaaatcatatacaaaaggtccaataagatcttaacactcaaacataacaaaacaagattagtttcttagcttcaagtgaactcatcaaactaacagataaaaaggttttgtttttctttttctatgaaaaaaaaaaaaactcaaacttgagcagagtagtgagtacccttttcatggcgacagcagcacaagcaagattaagtttactcttgagaaatgctctgtattcctctgaatctacaggaacattaggaggagaggagacggaaacaccacacgccgtcgtagattctccgtcgtctgcagcggcggaggattcttgtatgaaacgattgaatgcccattcggaagcactgcgattcaacgacgtcattccattaaccgaccagtgatggttaccggagatttcttcgtcggagaaaactttttccat

SEQ ID NO: 1122 - DNA, 513 bp, Arabidopsis thaliana; identical to SEQ ID NO: 98
  G736 cDNA Sequence

SEQ ID NO: 1123 - protein, 170 aa, Arabidopsis thaliana
  G736 Amino Acid Sequence
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 1124 - DNA, 513 bp, Arabidopsis thaliana
  G736 DNA sequence used for BLAST
tcagcacgattgaccgtcggagtaacaccggagccgcttcatgggaaaatcatgccggaaactaccgtgagctgcggctgcggcatgctgccactcctcaacgagcaagccatttataagctcgacttggcgaacaccatttccatctccaagcataccaaccacgacacgaccaggtggtttggacttccgacgaccggcgccgacgggaacgttccggagtgcaccaccggcggtccagtaacggtggcagcctttacaaaagtgtcgaggctgattaacgttgtagttgttgaagtaacagaactttgtctccatgctcttgcatcttggacatgctatgatcttatccggacgcttctcggccgtcagatccgatgatgatgatgatctaacggctattgtggcttcttgctccggcgggtgtgtctcttcttcattttttattgttcgagtgttaaatgcaatagttttgccaaagagtttaatcccttgagaatcttgagtcgccat

SEQ ID NO: 1125 - DNA, 1212 bp, Arabidopsis thaliana; identical to SEQ ID NO: 106
  G740 cDNA Sequence

SEQ ID NO: 1126 - protein, 299 aa, Arabidopsis thaliana
  G740 Amino Acid Sequence
MASEDQSAARSTGKVNWFNASKGYGFITPDDGSVELFVHQSSIVSEGYRSLTVGDAVEFAITQGSDGKTKAVNVTAPGGGSLKKENNSRGNGARRGGGGSGCYNCGELGHISKDCGIGGGGGGGERRSRGGEGCYNCGDTGHFARDCTSAGNGDQRGATKGGNDGCYTCGDVGHVARDCTQKSVGNGDQRGAVKGGNDGCYTCGDVGHFARDCTQKVAAGNVRSGGGGSGTCYSCGGVGHIARDCATKRQPSRGCYQCGGSGHLARDCDQRGSGGGGNDNACYKCGKEGHFARECSSVA

SEQ ID NO: 1127 - DNA, 900 bp, Arabidopsis thaliana
  G740 Genomic Sequence
atggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaa

SEQ ID NO: 1128 - DNA, 900 bp, Arabidopsis thaliana
  G740 DNA sequence used for BLAST
ttaagctacagaagaacattcccttgcaaagtgaccttccttaccacacttgtagcacgcattatcattacctcctccaccgcttcctctctggtcacaatcacgagccaagtgaccagaaccaccacactggtaacacccacgagaaggctgtctcttagtcgcacaatctcttgcaatgtgaccaactccaccgcatgaataacaagttccactaccaccaccaccgcttctgacgtttccggcagcaaccttctgagtacaatccctagcaaagtgaccaacatcaccacaagtgtagcaaccatcgtttccacctttgaccgctccacgttggtctccgtttccaactgatttctgagtacaatccctagccacgtgaccaacatcaccgcaagtgtagcaaccatcgtttccacctttggtggctccacgttggtcaccgtttccagctgaagtacaatccctagcgaagtgaccagtatcaccacaattgtaacaaccttctcctcctctagatctacgttcaccacctccgccgccgccaccaataccacaatctttagagatatgacctaactcaccgcaattgtagcaaccgcttccaccgccgccgcgcctagcaccgttaccacgagagttattctccttcttgagagaaccaccaccaggagcagtaacattgacggctttagtcttaccgtcgcttccctgagtaatagcgaactcaaccgcatcgccgacggttaaactccggtaaccttcggagacaattgaagattgatgaacgaaaagctctacgctgccatcgtcaggagtaatgaaaccatagcctttagaagcgttgaaccagttcaccttcccggtagatctcgccgccgattgatcctctgaagccat

SEQ ID NO: 1129 - DNA, 782 bp, Arabidopsis thaliana
  G743 cDNA Sequence
tcagctcctcctacacagtttcttctctgaatctacttaggaagctaaaatgggtagatgtccgactagaaaagtgaagaagaggagattatctcacaaaacagctcgccgtgacaaattcgaagtcaaaggcgatgacttggtttacacagagttgcgtaaaccggagacggagattaagccgttacagcttgacgaggatttgcctggaatgggtcaattctactgcttacactgcgatcgatacttctccaacgcatcagtgagggatgatcatttcaagactaagaaacacaagaagcgtgtgaatatgatgatgggacaagcgccacactcgcaactcgatgcagatttagccgggggaatggggatgccggacaatggcccaaagctgatgtctaatttggtattcacagagttgcgtaaaccagagacggaggatttacctggaatgggtcaattcaactgcttactctgccatcggaacttctccaatgcatcagtgatggattatcatttcaagactaagaaacacaaaaagcgtgtgaagaagatagagggaccagcgccacactcgcaactcgatgcagatttagctggtggaatgggaatgccagagctgatgtctgcctgagttttacagttattttccttatttagttaatggaacccggaattttgttgtaaaactataatctcctaaattaatgatacaggttttttgtctgttgccaagtatctatcatgcagttactggtttagcttcaaaaaaaaaaaaaaaa

SEQ ID NO: 1130 - protein, 194 aa, Arabidopsis thaliana
  G743 Amino Acid Sequence
MGRCPTRKVKKRRLSHKTARRDKFEVKGDDLVYTELRKPETEIKPLQLDEDLPGMGQFYCLHCDRYFSNASVRDDHFKTKKHKKRVNMMMGQAPHSQLDADLAGGMGMPDNGPKLMSNLVFTELRKPETEDLPGMGQFNCLLCHRNFSNASVMDYHFKTKKHKKRVKKIEGPAPHSQLDADLAGGMGMPELMSA

SEQ ID NO: 1131 - DNA, 1346 bp, Arabidopsis thaliana
  G743 Genomic Sequence
atgggtagatgtccgactagaaaagtgaagaagaggagattatctcacaaaacagctcgccgtgacaaattcgaagtcaaaggcgatgacttggtttacacagagttgcgtaaaccggagacggagattaagccgttacagcttgacgaggatttgcctggaatgggtcaattctactgcttacactgcgagtaagagagattctatgattactctattgacgattcttttggtttatgaaacttttttttagcaaatacattatctttgaattactctatatgacccatttgtttgttttaccttgatatgttttagtcgatacttctccaacgtatcagtgagggatgatcatttcaagactaagaaacacaagaagcggtatgtggattcttctccttccttggccttggtttctattttgttttgtgttcttggaactgtgtttggttcttgtgctcgtttactttcttgcttgcaatgttaaagctatttctcttcacttctgtgtacctaaagatgttttagcatttgtaatttgattacctttgtatgattatacatgtctgttgcagtgttgctctgtactcaagacttattatatgtgttttgtccacttggattgcagtgtgaatatgatgatgggacaagcgccacactcgcaactcgatgcagatttagccgggggaatggggatgccggacaatggcccaaagctgatgtctaatttggtattcacagagttgcgtaaaccagagacggaggatttacctggaatgggtcaattcaactgcttactctgccagtaagattatatgtgcaaaaagacaatctttgaattactctagatttccatgtttgtgtgaacatttgtttgtatttgattgaccttgtctctctaccttgatatttttcagtcggaacttctccaatgcatcagtgatggattatcatttcaagactaagaaacacaaaaagcggtatgtggattcttcttccttggtcttggtttctatcttgttttgatcttggaactgtgtttggttcttgtgctcgtctactttgaattcatcttgctggcaatgttaaagctatttctcgtcactggcgtagctaaaaatgttttagcacttgtaacttgattacctctgtatgattatattattgatctatgcatgtctgttgctctgtactcagacttaatatctttctattgtccatttggatttttgtgtgattgcagtgtgaagaagatagagcgaccagcgccacactcgcaactcgatgcagatttagctggtggaatgggaatgccagacaatggtccaaagctgatgtctgcctga

SEQ ID NO: 1132 - DNA, 1346 bp, Arabidopsis thaliana
  G743 DNA sequence used for BLAST
tcaggcagacatcagctttggaccattgtctggcattcccattccaccagctaaatctgcatcgagttgcgagtgtggcgctggtcgctctatcttcttcacactgcaatcacacaaaaatccaaatggacaatagaaagatattaagtctgagtacagagcaacagacatgcatagatcaataatataatcatacagaggtaatcaagttacaagtgctaaaacatttttagctacgccagtgacgagaaatagctttaacattgccagcaagatgaattcaaagtagacgagcacaagaaccaaacacagttccaagatcaaaacaagatagaaaccaagaccaaggaagaagaatccacataccgctttttgtgtttcttagtcttgaaatgataatccatcactgatgcattggagaagttccgactgaaaaatatcaaggtagagagacaaggtcaatcaaatacaaacaaatgttcacacaaacatggaaatctagagtaattcaaagattgtctttttgcacatataatcttactggcagagtaagcagttgaattgacccattccaggtaaatcctccgtctctggtttacgcaactctgtgaataccaaattagacatcagctttgggccattgtccggcatccccattcccccggctaaatctgcatcgagttgcgagtgtggcgcttgtcccatcatcatattcacactgcaatccaagtggacaaaacacatataataagtcttgagtacagagcaacactgcaacagacatgtataatcatacaaaggtaatcaaattacaaatgctaaaacatctttaggtacacagaagtgaagagaaatagctttaacattgcaagcaagaaagtaaacgagcacaagaaccaaacacagttccaagaacacaaaacaaaatagaaaccaaggccaaggaaggagaagaatccacataccgcttcttgtgtttcttagtcttgaaatgatcatccctcactgatacgttggagaagtatcgactaaaacatatcaaggtaaaacaaacaaatgggtcatatagagtaattcaaagataatgtatttgctaaaaaaaagtttcataaaccaaaagaatcgtcaatagagtaatcatagaatctctcttactcgcagtgtaagcagtagaattgacccattccaggcaaatcctcgtcaagctgtaacggcttaatctccgtctccggtttacgcaactctgtgtaaaccaagtcatcgcctttgacttcgaatttgtcacggcgagctgttttgtgagataatctcctcttcttcacttttctagtcggacatctacccat

SEQ ID NO: 1133 - DNA, 1707 bp, Arabidopsis thaliana; identical to SEQ ID NO: 54
  G748 cDNA Sequence

SEQ ID NO: 1134 - protein, 448 aa, Arabidopsis thaliana
  G748 Amino Acid Sequence
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 1135 - DNA, 1689 bp, Arabidopsis thaliana
  G748 Genomic Sequence
atgatgatggagactagagatccagctattaagcttttcggtatgaaaatcccttttccgtcggtttttgaatcggcagttacggtggaggatgacgaagaagatgactggagcggcggagatgacaaatcaccagagaaggtactgattgataaaaagtaattttggcctgaaaattggaattgtcctaaaaataaatatgattagattagttttgtactagtaattaacttaactagttacttcttcagtctctgttttgtctgttttggatctacaatttgtgttattgagttacatgaacgaaattataacatagttccagtcttgtgttaccattaagatattactagttcatttagttgttagagattattggttctgaacttctgatgaagaataattgtttgattaagatttcataaagagaaacttcttttattcattgcaagtgttcttaatttagtgtttcttgtatctcaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgtgatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaacgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttag

SEQ ID NO: 1136 - DNA, 1689 bp, Arabidopsis thaliana
  G748 DNA sequence used for BLAST
ctaaatctgttcatggaaattgtgtgatcttgatagagcagcagggttagcagaaagaacaggggagttctcagctttgtcgttgttatacatctttgtcttatgatcaaaccctttgaacataccaccggctttgcacatcgcctcgttcttgattcccaatgttgtccatatcgagctctttgctgcttcgttaggatcatctattctcaacgttttcgggaccagaacgcacccggccttctgttttcgctctgtctcgttgtcctttttcgatgatccttcatctctcggatgctttccgagagtcggagagtttgtatttgaacacttttggcttataggcgatgaggattgatgcggtggtagcattgggatggtccagtaagggtaaaacggcattggataccctggaggcgggtaaaaacctggtggaggcatcgctggattccacgtgtaaggccatggaacacctgggatgcaagcataaccattcatgttattgttgttgttgttgttcatttgtgcttcaacaacactgccgctttgtgctcttgattcatccactgagtgattgttagaggtggtcacagaggatccgcttgagcaatcatctccattctctacccgagctacaagccgttgatccgctaacccgtgaaacctgttcctagcaccgtttgagaccttttgatcttcttgtagcttcatcacaggtgtcatgggagcagcaacgtgctgctgctgagcttcgagaccaaaactcaagacccttgtgtttgcctgtaagcccgggtcaagcctcgcagcctcaagagcctcggaaatagtgatgtgacggtaatgagaagatgagcttttgttcttacgacgtcctgcccccacaggaacattcctcatagtccctccagcagtccaatatctctgacaagccttgcagaaatgacgaggctggtttatgttgtagttgttgtaataacagaacttggtctccatgcttttgcatctcggacacggtagaatcttagtcggtttctttagggttttaccatcaggtgtcgtctgctgattatcctcaggcgtgtcactactctctatctgatcagttgatgtcgcttcctctttgtccaaggtttcgggtttcgaattgttaaaactgttgtcgttacagttgttgttgttcttatctgataactctggagttacctgagatacaagaaacactaaattaagaacacttgcaatgaataaaagaagtttctctttatgaaatcttaatcaaacaattattcttcatcagaagttcagaaccaataatctctaacaactaaatgaactagtaatatcttaatggtaacacaagactggaactatgttataatttcgttcatgtaactcaataacacaaattgtagatccaaaacagacaaaacagagactgaagaagtaactagttaagttaattactagtacaaaactaatctaatcatatttatttttaggacaattccaattttcaggccaaaattactttttatcaatcagtaccttctctggtgatttgtcatctccgccgctccagtcatcttcttcgtcatcctccaccgtaactgccgattcaaaaaccgacggaaaagggattttcataccgaaaagcttaatagctggatctctagtctccatcatcat

SEQ ID NO: 1137 - DNA, 1423 bp, Arabidopsis thaliana
  G749 cDNA Sequence
aaaaaaagaactctttcgtcgactaatgtgatttattgttcaccggagtattaaagaagatgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgtttctttgctcattcaccggatcagcttaggtttttacatactcggagccctgacagagttgattcttttgacgtttcgtctccgattcgtgctagagcatttcagctgtcgatttctccggtttctggttcgccaccgatgagtccaagagctgactcggagtcttctccgatgactcagtcactgagtcgatctctcgggtcttgttcgataaacgacgtcgttccttcgtttaggaatttacagtttaattcggtaaaatcatttcctcgtaacaatcctttattcggattcgggtcgccccgtggatcgatcttgggtcctgggtttcagtctctgcctacaacaccgacccgaccagggaatctggatatttgggagtatggtttggaggaagaacccgtaatggagcgtgtcgttgagtcgggtcgtgagctacgagaaaagatgcgcgagaaactgcacaaggagaattgcatggatcgagttgcccaggatccggatcagaatttgggtgaggctcctgatgtcgggtgggtatctgacctgctcatgtaaagaaaaaaatctgaccgtatttcgaagtctcattggcttttttggatatcttccaaggaaaagaggaagggatcttagtgtgttcatattattttatttactaatctcgtattttatctgctaataagaattaattatggattttggggcctgatttttctaagatgatcgttgtatagatgtgccttagggttttaattatgaaatagtattaatataatcgtgttttataagactataatgttagattgtaaccacttggtactaatctatgaatgaatgcaaattattat

SEQ ID NO: 1138 - protein, 356 aa, Arabidopsis thaliana
  G749 Amino Acid Sequence
MMIGETRRTYPTVEIPPWPVLEELTTSEFFSPVMNSPDCSMLEALAGLQRYLPSNEPDPESYPDLLGPDSPIDAYSCDHFRMYDFKVRRCARGRSHDWTECPYAHPGEKARRRDPRKYHYSGTACPDFRKGGCKKGDSCEFAHGVFECWLHPARYRTQPCKDGGNCLRKICFFAHSPDQLRFLHTRSPDRVDSFDVSSPIRARAFQLSISPVSGSPPMSPRADSESSPMTQSLSRSLGSCSINDVVPSFRNLQFNSVKSFPRNNPLFGFGSPRGSILGPGFQSLPTTPTRPGNLDIWEYGLEEEPVMERVVESGRELREKMREKLHKENCMDRVAQDPDQNLGEAPDVGWVSDLLM

SEQ ID NO: 1139 - DNA, 543 bp, Arabidopsis thaliana
  G749 Genomic Sequence
atgatgatcggagaaactcgcaggacttatcccactgttgaaatacctccatggccggtacttgaagagcttacaacgtcggagtttttttctccggtgatgaatagtccagattgtagcatgcttgaagctttggcggggttgcagcgttatttgccgtctaacgaaccggatccggagtcatacccggatctattgggtccggattcaccaatcgatgcttactcatgcgaccatttccgtatgtacgatttcaaagtcaggaggtgtgctcgtggccggagtcatgattggacggagtgtccgtacgctcatcccggagaaaaagctcgccggagagatccgaggaagtaccattactctggtacggcttgtcctgattttcgtaaaggtggctgcaagaaaggtgactcttgtgagtttgctcatggtgttttcgagtgttggcttcatccagctcgttaccgtactcagccgtgtaaagacggtggtaactgtctccggaaaatttgttttctttgctcattcaccggatcagcttag

SEQ ID NO: 1140 - DNA, 542 bp, Arabidopsis thaliana
  G749 DNA sequence used for BLAST
ctaagctgatccggtgaatgagcaaagaaacaaattttccggagacagttaccaccgtctttacacggctgagtacggtaacgagctggatgaagccaacactcgaaaacaccatgagcaaactcacaagagtcacctttcttgcagccacctttacgaaaatcaggacaagccgtaccagagtaatggtacttcctcggatctctccggcgagctttttctccgggatgagcgtacggacactccgtccaatcatgactccggccacgagcacacctcctgactttgaaatcgtacatacggaaatggtcgcatgagtaagcatcgattggtgaatccggacccaatagatccgggtatgactccggatccggttcgttagacggcaaataacgctgcaaccccgccaaagcttcaagcatgctacaatctggactattcatcaccggagaaaaaaactccgacgttgtaagctcttcaagtaccggccatggaggtatttcaacagtgggataagtcctgcgagtttctccgatcatcat

SEQ ID NO: 1141 - DNA, 1299 bp, Arabidopsis thaliana
  G751 cDNA Sequence
tcttgccaaaataaaaaataaaaaaggagtttgttgtgaagccaatgaacgagatcgtgacaaacacatgcctaaaacaacagtcgaatcctccttctcctgctactcctgtggaaaggaaggcaagaccggagaaagaccaggctttgaactgtccaagatgcaactccttaaacaccaagttctgttactacaacaactacagcctgacgcagcccaggtacttttgtaaagactgcaggaggtattggaccgcaggtggttccctcaggaacatccccgtcggtggcggcgtccgcaagaacaagagatcttcttccaattcctcttcctcttcaccctcttcgtcttcttcttcaaagaaacctctttttgccaacaacaacacgcctacgcctcctcttcctcatcttaaccctaagattggtgaagcagccgctactaaagttcaagacttgacgttttctcaagggtttgggaacgcccacgaggttaaagatctcaacttggcgttttctcaagggtttgggatcggtcacaatcatcacagtagtatcccagagtttctgcaagtagtacccagcagcagtatgaagaacaacccactggtctcaacttcctcgtctttggagcttttagggatctctagttcctctgcttcctctaactcacgccctgctttcatgtcttatccaaatgttcatgattcatcggtctacacagcatccgggtttggtctgagttacccacagtttcaagagttcatgagaccagctttgggattctctcttgatggtggggatcctctacgtcaagaagaggggtccagtggcactaataatggaaggccgttgctgccatttgagagcctcctcaaacttccagtttcatcatcaagcaccaatagtggtgggaatggcaatctgaaagagaataatgatgagcatagtgatcatgaacatgagaaagaagaaggagaagctgaccaatctgttgggttttggagtggcatgttaagtgctggtgcttctgctgctgcatctggtggttcatggcaataattttagtcatggaccccatcccatgagagtttttagaagaaatgattacatttttcacccatgttttaaaaagatgagagggttaactatataatctgggtgcttactattttagtccttttcctttggtttccttctccttttctaaaaattattattaactttgttgggttggggatggatactgtatgtatttagactctcttttaaatcaatctcagttgttagttacctaaaa

SEQ ID NO: 1142 - protein, 338 aa, Arabidopsis thaliana
  G751 Amino Acid Sequence
MNEIVTNTCLKQQSNPPSPATPVERKARPEKDQALNCPRCNSLNTKFCYYNNYSLTQPRYFCKDCRRYWTAGGSLRNIPVGGGVRKNKRSSSNSSSSSPSSSSSSKKPLFANNNTPTPPLPHLNPKIGEAAATKVQDLTFSQGFGNAHEVKDLNLAFSQGFGIGHNHHSSIPEFLQVVPSSSMKNNPLVSTSSSLELLGISSSSASSNSRPAFMSYPNVHDSSVYTASGFGLSYPQFQEFMRPALGFSLDGGDPLRQEEGSSGTNNGRPLLPFESLLKLPVSSSSTNSGGNGNLKENNDEHSDHEHEKEEGEADQSVGFWSGMLSAGASAAASGGSWQ

SEQ ID NO: 1143 - DNA, 1017 bp, Arabidopsis thaliana
  G751 DNA sequence used for BLAST
atgaacgagatcgtgacaaacacatgcctaaaacaacagtcgaatcctccttctcctgctactcctgtggaaaggaaggcaagaccggagaaagaccaggctttgaactgtccaagatgcaactccttaaacaccaagttctgttactacaacaactacagcctgacgcagcccaggtacttttgtaaagactgcaggaggtattggaccgcaggtggttccctcaggaacatccccgtcggtggcggcgtccgcaagaacaagagatcttcttccaattcctcttcctcttcaccctcttcgtcttcttcttcaaagaaacctctttttgccaacaacaacacgcctacgcctcctcttcctcatcttaaccctaagattggtgaagcagccgctactaaagttcaagacttgacgttttctcaagggtttgggaacgcccacgaggttaaagatctcaacttggcgttttctcaagggtttgggatcggtcacaatcatcacagtagtatcccagagtttctgcaagtagtacccagcagcagtatgaagaacaacccactggtctcaacttcctcgtctttggagcttttagggatctctagttcctctgcttcctctaactcacgccctgctttcatgtcttatccaaatgttcatgattcatcggtctacacagcatccgggtttggtctgagttacccacagtttcaagagttcatgagaccagctttgggattctctcttgatggtggggatcctctacgtcaagaagaggggtccagtggcactaataatggaaggccgttgctgccatttgagagcctcctcaaacttccagtttcatcatcaagcaccaatagtggtgggaatggcaatctgaaagagaataatgatgagcatagtgatcatgaacatgagaaagaagaaggagaagctgaccaatctgttgggttttggagtggcatgttaagtgctggtgcttctgctgctgcatctggtggttcatggcaataa

SEQ ID NO: 1144 - DNA, 1699 bp, Arabidopsis thaliana
  G752 cDNA Sequence
ccggcaagaacagaacgctcttctatttttctccatcttccaatttccaggaacaagattggacgaaagctaaaggtattgcatccatttaaaaagttcatggataggtggtccagtaaaagagccatggaggcgagacctgactctaagaagaagggtggtgttgtttttagagatagatttaacagcaatagttgcaaggttcctatttgtagtgatgagaaaaaatcaatgaactttactaggtttgttggctcttcagataagaaagagaaatcagtgttgtctacataccgctcttcgccaaacgggaaggaagtaattggaacttcctctaagatttgtatctctagctcctcttctgtgaaaagtggtgagaagcaaccgttttctcagatagccattgattcatcagagagcagcagaggtagtgaagacgaggtagagtcagaaatcttgcaagttcctcttggaagagataaaagaagaatgaacaataaacttatttatggaaaagttataacacctgaagcggaatgctcaaagttgccatcaagctcaagaatcaagagaggttttaggcagagatttgggttgagcaagcaagagtttcatcctggtccatctggccagtcaacatctgctaaccggggatgcagcccgttgttgtcaggtgtcattccaagtggttttggattggacaaaagattaagtcggaaggcagatacaatcagtaagacaaaagtttacggagaaagcagttctagctcctcagctagggggaagaatgtaacagaacctccaccagttgaagtgagacgtcgtagttttaatccgagaggttctgtttctgatagtagacgggctagacactgcattttggatgatgacaacgatgttgcttcagttgggagtcagagattggcaaatagaaataatagtcgcattagagggagtggtagagacggtttatcctctgtcacggcagcagagatgtctcagactgaaacatcaaacaatctcaattctcctgtctctttggagctgttctctggttttccagaatttggcctctctggttccttattgagtcatgacagttttcgcagttataatttagatgggatctccgagattctgccagaacttgataggatcgaacaagatatcgaacttaattatgaggatctgcttatcatggaaacaggtttacttctcggtggactaagcttccatgaccaacaccgagacatgaggctagacatcgataacatgtcatatgaggaactattagctctagaagagaggattggtacagtaagcactgctttgacagaagaagcaatatcaaagtgcttgaaaacaagtatctatcagatgaaacctttgagttatgggtctatcaccaaaagtcctagtgataacaaggaagatgccaaatgcagcatctgccaggaagaatatacgattggagatgaagttgggaggctacactgtgagcacacataccatgtgaagtgtgtgcaagagtggttgcggataaagagttggtgcccaatctgcaaagccacagccgaaacctcctctaaataaccgtcttcttcttcttcctcgttcgttgtattagttctttcatctaaagcctgtgaacaacaatggaacctgcgtaaaaaaggcctcaccatttcctttgtgtaaa

SEQ ID NO: 1145 - protein, 497 aa, Arabidopsis thaliana
  G752 Amino Acid Sequence
MDRWSSKRAMEARPDSKKKGGVVFRDRFNSNSCKVPICSDEKKSMNFTRFVGSSDKKEKSVLSTYRSSPNGKEVIGTSSKICISSSSSVKSGEKQPFSQIAIDSSESSRGSEDEVESEILQVPLGRDKRRMNNKLIYGKVITPEAECSKLPSSSRIKRGFRQRFGLSKQEFHPGPSGQSTSANRGCSPLLSGVIPSGFGLDKRLSRKADTISKTKVYGESSSSSSARGKNVTEPPPVEVRRRSFNPRGSVSDSRRARHCILDDDNDVASVGSQRLANRNNSRIRGSGRDGLSSVTAAEMSQTETSNNLNSPVSLELFSGFPEFGLSGSLLSHDSFRSYNLDGISEILPELDRIEQDIELNYEDLLIMETGLLLGGLSFHDQHRDMRLDIDNMSYEELLALEERIGTVSTALTEEAISKCLKTSIYQMKPLSYGSITKSPSDNKEDAKCSICQEEYTIGDEVGRLHCEHTYHVKCVQEWLRIKSWCPICKATAETSSK

SEQ ID NO: 1146 - DNA, 1699 bp, Arabidopsis thaliana; identical to SEQ ID NO: 1144
  G752 DNA sequence used for BLAST

SEQ ID NO: 1147 - DNA, 1212 bp, Arabidopsis thaliana
  G759 cDNA Sequence
aaaaaatatgggtatccaagaaactgacccgttaacgcaattgagtttaccaccgggtttccgattttacccgaccgatgaagagcttatggttcaatatctctgtagaaaagcagctggttacgatttctctcttcagctcatcgccgaaatagatctttacaaattcgatccatgggttttaccaaataaagcattatttggagaaaaagaatggtatttttttagtcctagggatagaaaatatccaaacgggtcaagacctaaccgggttgccggatcgggttattggaaagctacgggtacggataaaataatctcgacggaaggacaaagagttggtattaaaaaagctttggtgttttacatcggaaaagctcctaaaggtactaaaaccaattggatcatgcatgagtatcgtctcattgaaccttctcgtagaaacggaagcactaagttggatgattgggttctatgtcgaatatacaagaagcaatcaagtgcacaaaaacaagtttacgataatggaatcgcgaatgctagagaattcagcaacaacggtacttcgtccacgacgtcgtcttcttctcactttgaagacgttcttgattcgtttcatcaagagatcgacaacagaaatttccagttttctaacccaaaccgcatctcgtcgctcagaccggacttaaccgaacagaaaaccgggttccacggtcttgcggatacttctaacttcgattgggctagttttgccggtaatgttgagcataataactcggtaccggaactcggaatgagtcatgttgttcctaatctcgagtacaactgtggctacctgaagacggaggaggaagtcgagagcagtcacgggtttaataactcgggcgagttagctcaaaagggttatggtgttgactcgtttgggtattcggggcaagttggtgggtttgggtttatgtgatgatgaaatgctgacgcaataaaaataagtcgttaatttttgtcccgtggcaaatcttatatgtatttgaatttcaattcttttgggttaagagggagactcatagatttagatgtagatttgtaatctttcatgcatagaaaatttgacgaatagatttcgtaactttattttgttgctgtttggttatctttgtattggtataaatttagtggattgaaattgcatattgaaaaaaaaaaaaaaaaaaa

SEQ ID NO: 1148 - protein, 317 aa, Arabidopsis thaliana
  G759 Amino Acid Sequence
MGIQETDPLTQLSLPPGFRFYPTDEELMVQYLCRKAAGYDFSLQLIAEIDLYKFDPWVLPNKALFGEKEWYFFSPRDRKYPNGSRPNRVAGSGYWKATGTDKIISTEGQRVGIKKALVFYIGKAPKGTKTNWIMHEYRLIEPSRRNGSTKLDDWVLCRIYKKQSSAQKQVYDNGIANAREFSNNGTSSTTSSSSHFEDVLDSFHQEIDNRNFQFSNPNRISSLRPDLTEQKTGFHGLADTSNFDWASFAGNVEHNNSVPELGMSHVVPNLEYNCGYLKTEEEVESSHGFNNSGELAQKGYGVDSFGYSGQVGGFGFM

SEQ ID NO: 1149 - DNA, 1153 bp, Arabidopsis thaliana
  G759 DNA sequence used for BLAST
tcacataaacccaaacccaccaacttgccccgaatacccaaacgagtcaacaccataacccttttgagctaactcgcccgagttattaaacccgtgactgctctcgacttcctcctccgtcttcaggtagccacagttgtactcgagattaggaacaacatgactcattccgagttccggtaccgagttattatgctcaacattaccggcaaaactagcccaatcgaagttagaagtatccgcaagaccgtggaacccggttttctgttcggttaagtccggtctgagcgacgagatgcggtttgggttagaaaactggaaatttctgttgtcgatctcttgatgaaacgaatcaagaacgtcttcaaagtgagaagaagacgacgtcgtggacgaagtaccgttgttgctgaattctctagcattcgcgattccattatcgtaaacttgtttttgtgcacttgattgcttcttgtatattcgacatagaacccaatcatccaactaaagaaaattaacaagaatattaattataggtcattcaaaacactacaagaagaaaatataagatatagtatttattaatgtttagattttatttgttaccttagtgcttccgtttctacgagaaggttcaatgagacgatactcatgcatgatccaattggttttagtacctttaggagcttttccgatgtaaaacaccaaagcttttttaataccaactctttgtccttccgtcgagattattttatccgtacccgtagctttccaataacccgatccggcaacccggttaggtcttgacccgtttggatattttctatccctaggactaaaaaaataccattctttttctccaaataatgctttatctataaatcacaaaagaagaaaaaccaagaaaattatgaatctctgttaagaaaaataaacattttttgagaagggtttcaattagtatatacttacttggtaaaacccatggatcgaatttgtaaagatctatttcggcgatgagctgaagagagaaatcgtaaccagctgcttttctacagagatattgaaccataagctcttcatcggtcgggtaaaatcggaaacccggtggtaaactcaattgcgttaacgggtcagtttcttggatacccat

SEQ ID NO: 1150 - DNA, 885 bp, Arabidopsis thaliana
  G763 cDNA Sequence
tctctctctttgtttggaaccaccatggataatgtcaaacttgttaagaatggtgttttgagattgccacctggattcagattccatcctactgatgaagaacttgtggttcaataccttaagaggaaagtttgttcttctcctttgccagcttcaatcatccctgagtttgatgtttgcagagctgatccttgggatttacctcgcaatttggagaaagagaggtacttctttagcacaagggaagctaaatacccaaatgggaaccggtctaaccgggcaactgggtctggttattggaaagctaccggtattgataaacgggttgtgacctctagaggaaatcaaatcgttggtttgaagaaaactcttgtcttctacaaaggcaaaccacctcatggctcaagaaccgattggatcatgcacgaatatcgcctctcttcttctcctccgagttctatgggtcccactcagaactgggtactctgtcgtatcttcttgaagaaaagagccggtaacaagaacgacgacgacgacggagatagccgtaatcttagacataataataataacaattcgagtgaccaaattgagataattacaacagaccaaacagatgataaaacaaaaccaatcttctttgatttcatgagaaaagaaagaacaacagatttgaaccttttgccgagctctccttcttccgatcatgcttcaagtggagtcacgacggagatcttctcttcttccgatgaagagaccagtagttgcaatagtttcagatgaaatctttaatttaattttaatgttgactatcttaataagttattatagttttatattaatacgactctctttcctttttattccatttttacttgaaaacga

SEQ ID NO: 1151 - protein, 252 aa, Arabidopsis thaliana
  G763 Amino Acid Sequence
MDNVKLVKNGVLRLPPGFRFHPTDEELVVQYLKRKVCSSPLPASIIPEFDVCRADPWDLPRNLEKERYFFSTREAKYPNGNRSNRATGSGYWKATGIDKRVVTSRGNQIVGLKKTLVFYKGKPPHGSRTDWIMHEYRLSSSPPSSMGPTQNWVLCRIFLKKRAGNKNDDDDGDSRNLRHNNNNNSSDQIEIITTDQTDDKTKPIFFDFMRKERTTDLNLLPSSPSSDHASSGVTTEIFSSSDEETSSCNSFR

SEQ ID NO: 1152 - DNA, 935 bp, Arabidopsis thaliana
  G763 DNA sequence used for BLAST
atggataatgtcaaacttgttaagaatggtgttttgagattgccacctggattcagattccatcctactgatgaagaacttgtggttcaataccttaagaggaaagtttgttcttctcctttgccagcttcaatcatccctgagtttgatgtttgcagagctgatccttgggatttacctggtaaagctttctgattcttgctatatttagtaagttttcaatttagagtctctgtgacctttaaggctcataagattctcttatgtttttttaggcaatttggagaaagagaggtacttctttagcacaagggaagctaaatacccaaatgggaaccggtctaaccgggcaactgggtctggttattggaaagctaccggtattgataaacgggttgtgacctctagaggaaatcaaatcgttggtttgaagaaaactcttgtcttctacaaaggcaaaccacctcatggctcaagaaccgattggatcatgcacgaatatcgcctctcttcttctcctccggtacatattcccactctctcaattcccggtttaagctccggtttaatcaccaccactaaaataagattctaatattttgtagagttctatgggtcccactcagaactgggtactctgtcgtatcttcttgaagaaaagagccggtaacaagaacgacgacgacgacggagatagccgtaatcttagacataataataataacaattcgagtgaccaaattgagataattacaacagaccaaacagatgataaaacaaaaccaatcttctttgatttcatgagaaaagaaagaacaacagatttgaaccttttgccgagctctccttcttccgatcatgcttcaagtggagtcacgacggagatcttctcttcttccgatgaagagaccagtagttgcaatagtttcagatga

SEQ ID NO: 1153 - DNA, 1198 bp, Arabidopsis thaliana
  G764 cDNA Sequence
atcgaattcgcggccgctcgatatctttacaaccattaaacaaaaaatttggccactacaagttgaaaaagttttgattatatctaatcgctgaaatggattacaaggtatcaagaagtggggagatagtagaaggagaagtagaagattcagaaaagattgatttaccacctggtttcagatttcacccaactgatgaagaacttataacacactatctaagaccaaaggttgtaaactcttttttctctgctatagctattggtgaagttgatctcaacaaagtcgagccttgggacttgccttggaaggctaagcttggggaaaaagagtggtacttcttttgcgtaagagaccgaaaatacccgactggtttaagaacgaatcgtgctactaaagccggttattggaaagctacagggaaagataaagagatcttcaaagggaaatctcttgttggtatgaagaaaacattggttttctacaaaggaagagctcctaaaggagtaaaaacaaattgggtcatgcatgagtatcgattagaaggcaaattcgctatcgataatctctctaaaaccgctaagaacgaatgtgttattagtcgtgtttttcatacacggactgatggtacgaaggagcatatgtccgttggtttacctccgctgatggattcttctccatatctaaagagtagaggacaagactctttagccgggaccacccttggtgggttgttgtctcacgttacctacttctccgaccaaacaaccgatgacaagagtcttgtggccgattttaaaactaccatgtttggttccggatcgactaactttttaccaaacataggttctctactagacttcgatcctctgtttctacaaaacaattcttcagtactgaagatgttgcttgacaatgaagaaacccaatttaagaagaatcttcacaattcaggttcatcagagagtgaactaacagcgagttcttggcaaggtcacaattcttatggttccactggtccagtgaatcttgattgcgtttggaaattctgaatttggaaaatcgaaaatttggatgttaactagggggtatatagggtttttaaaaacagtgtatatatgcgttatgtgttagctttagattctaggatatacaaagatgacactaatagattcttataacattttgtaaaaaaaaa

SEQ ID NO: 1154 - protein, 318 aa, Arabidopsis thaliana
  G764 Amino Acid Sequence
MDYKVSRSGEIVEGEVEDSEKIDLPPGFRFHPTDEELITHYLRPKVVNSFFSAIAIGEVDLNKVEPWDLPWKAKLGEKEWYFFCVRDRKYPTGLRTNRATKAGYWKATGKDKEIFKGKSLVGMKKTLVFYKGRAPKGVKTNWVMHEYRLEGKFAIDNLSKTAKNECVISRVFHTRTDGTKEHMSVGLPPLMDSSPYLKSRGQDSLAGTTLGGLLSHVTYFSDQTTDDKSLVADFKTTMFGSGSTNFLPNIGSLLDFDPLFLQNNSSVLKMLLDNEETQFKKNLHNSGSSESELTASSWQGHNSYGSTGPVNLDCVWKF

SEQ ID NO: 1155 - DNA, 1198 bp, Arabidopsis thaliana; identical to SEQ ID NO: 1153
  G764 DNA sequence used for BLAST

SEQ ID NO: 1156 - DNA, 1324 bp, Arabidopsis thaliana
  G773 cDNA Sequence
tccgggcaggtcttcaatctcagaaggcaaaaaagaaaatcaaagaagatagttttgtgattgttttctataaaaagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaatatagcgtagaattcgaactctagggttagatttaggttctacgacttgtattgtatattcgtcgtcatttgtcctgacatttacatttttgtaaacttttatagctggaacttttgtattgatcaattatttattagaaaaacagatattgcattggatctataaaaaaaaaaaaaaaaaa

SEQ ID NO: 1157 - protein, 317 aa, Arabidopsis thaliana
  G773 Amino Acid Sequence
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 1158 - DNA, 1152 bp, Arabidopsis thaliana
  G773 Genomic Sequence
atgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtacgtataacctaataaccttaaccgtgtttggtttctttgtagctagttatgtttttttctcttctaacttgtctttttggttctttgtaggtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaaggtataaatttagttaaatacatgatgtatccaaaaagataagtatatagtaattgtaattatactgttcaacgaataacatattttaaactgtttttatgttcagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttga

SEQ ID NO: 1159 - DNA, 1152 bp, Arabidopsis thaliana; identical to SEQ ID NO: 1158
  G773 DNA sequence used for BLAST

SEQ ID NO: 1160 - DNA, 1640 bp, Arabidopsis thaliana; identical to SEQ ID NO: 39
  G776 cDNA Sequence

SEQ ID NO: 1161 - protein, 451 aa, Arabidopsis thaliana
  G776 Amino Acid Sequence
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 1162 - DNA, 2534 bp, Arabidopsis thaliana
  G776 Genomic Sequence
ttattgtccattagcattgttcttcttgagttcctcgttctcctgacgcagcgcatcgatccttgactggagaatactgatcatagcttctgcactcatcatttcaagcttgaaagtttctctttcaacagacatctggtgaatctccttctggagatcattaaccttctcttcaggagatgcaagtggagtttgaggaggcaaaggttccttgtgaggacgtagcggttgctgcggcttttctttcttgtcggagatacccatgagtgagaactcaagcaatgcagagatggcagtgttggtggcagcggcagatgatgagattaaagtggttgtattgtcgacagttgttgttgtggacgaacaatggtcctgtgtgttcctgcttgagttgttgttggactcgctttggcgtctacgtttgtattgcagaagaggtaatggagcttctttgttgagaacgcatacaggtcgaggaggacgctcctcttcttccatctgctcgcgtttgagtgtttcctcgttttcatcataattattattgttgttatgctcctccggcttgaggtcattctcatgatgattctgttggtccgattcgatatccagtggagctgtctctctcggtggctcattgatgttgatgagactcttgctggctgactggatttcctacaacaaattacaagtgaaccccagacgacgcataaattatctgaaaccaaatgcttcaatcaattttgctgatgaaggattaaaactgcattttcactaaaacaacaaatcattctacttctggtcaacatttactgatcaattaagtgagttcatatgatgcacagtaaaattgctggtcaaatgaggatgcaaagtttgaacgatcttgtaatcagtatgattaagaataaagcccaagaaacaaaaaaaaaaaagaccaccgaaaattcagatatcttctaaatcaagagagttgattcatcagataaacctataaggttgatttctacaagagttggttacagactaaatggagttactagcgtcacagcccgctgaaacagttattaggagaagcttcacttcaacacagagttttgcagataataaatataatatcttgtgaaacaagagaaatgatgcatcagataaatttgtacatttgcactaaataacgttgaaatagtagattggttcataaatagactaatgcagttaaataaactcactcagcccaatggaaaactaagaaagagagtatttcaacagagttttttgcatacaagaaatattgaatgaaactaataaggtttgggtaatgaagccagagtaagaagaaatcacaaacctggtccatctggtcgtttccattggctactggcggcggctctagcctgagcttaacgtctattcctggaatcagagctccttcatcatcagcccattcctcttccatgaacggagcatatctgttcccacttggtggcccaatgttattcttgtggaagactctacacaacacatatgcatcttgctgcacccaaacaaagaattgagatcttttggaaattatcagataaaccaaattcgaaagtaatttggacaatacagtaccaccaggtttccgtttttctcggtttcatattccacaaggcgatactcatgcataacccaattagtccgaagcccgtctggtgcacgcccactgtggaaaacaagtgtctttttcataccgagaagcagaatgtcacggcggatttctctgtcttttccagtagctttccagtaccctctgttagttgctcggttcatcctagcaccgtttccatacttcttatctaatgcactgtagaagtaccattcttggtcccttgtcttcaatctcgaaaacacttaaacacacaacacaactaagaaattacttaaaaccagacttaactcaaaacttcaaactttttacatttcctgaaccacaagcaaacaaaactatagcacaagtaagcataaaattctaacggaatctggaaaaaacgaatatttgaaccacttaagaagtcgattagatgaaatactaccttcacggtgttatagcctaaacatagcaaaatgtaacaacagagaatctgcaacaaaatttcccagaaaaatgaatcggaacctaaaaaggtaaaaccttttttccaagaattgagtcagaagaagcgagagaagcccagaccacaaaaatcccaaatcagaagcaacaaattcacagaaaacccccaaatggaagagatgcacagaaaccaagagagagtggaagtgaaacccagcgaacctgctaaatcccagggctcatgcttgtatatatcgacctctccaatcgcatcgaagcgtacaggttggcccagaaccttcctcttcaagtaatagctcacgagttcctcatcagtcggatgaaatcggaagccaggagcaagcgaggtcgccaccgaagcagtacccggagcagtcgccgagggcggcgcagtcacaacagccacagattcgcgacccat

SEQ ID NO: 1163 - DNA, 2534 bp, Arabidopsis thaliana; identical to SEQ ID NO: 1162
  G776 DNA sequence used for BLAST

SEQ ID NO: 1164 - DNA, 1057 bp, Arabidopsis thaliana; identical to SEQ ID NO: 80
  G777 cDNA Sequence

SEQ ID NO: 1165 - protein, 286 aa, Arabidopsis thaliana
  G777 Amino Acid Sequence
MDQPMKPKTCSESDFADDSSASSSSSSGQNLRGAEMVVEVKKEAVCSQKAEREKLRRDKLKEQFLELGNALDPNRPKSDKASVLTDTIQMLKDVMNQVDRLKAEYETLSQESRELIQEKSELREEKATLKSDIEILNAQYQHRIKTMVPWVPHYSYHIPFVAITQGQSSFIPYSASVNPLTEQQASVQQHSSSSADASMKQDSKIKPLDLDLMMNSNHSGQGNDQKDDVRLKLELKIHASSLAQQDVSGKEKKVSLTTTASSSNSYSLSQAVQDSSPGTVNDMLKP

SEQ ID NO: 1166 - DNA, 1171 bp, Arabidopsis thaliana
  G777 Genomic Sequence
atggatcaaccaatgaaaccaaaaacttgctctgaatctgattttgctgatgattcctctgcttcttcttcttcttcttcgggacaaaatctcaggttttagtgcttaaagatgttaactttacatggctgtgtcatgtttattcatagtttcgtctaattacagaggagctgagatggtggtggaagtgaagaaggaagcagtttgttcccagaaagcagagcgagagaagcttcgtagagataagcttaaggaacagtttcttgagcttggaaatgcacttggtatatatcttttcacaagatgaatacagattttcaaaattttctttgaattgagtttagagtaatggtttctttctacagatccgaataggcctaagagtgacaaagcctcagttctcactgatacaatacaaatgctcaaggatgtaatgaaccaagttgatagactaaaagctgagtatgaaacactatctcaagagtctcgtgaggtgatttgattaactttgtccattctcttattggatttatagttgaatatgctctgctcaagtgctcatcttccagttcgtttgatcagctaattcaagagaagagtgagctgagagaggagaaagcgactttaaagtctgatatcgagattcttaatgctcaatatcagcatagaatcaaaaccatggttccatgggtacctcattacagttatcatatccccttcgtagccataactcagggtcagtccagttttataccttattcagcctctgtcaatcctctaaccgaacaacaagcatcggttcagcagcattcttcttcttctgccgatgcttcaatgaaacaagattccaaaatcaagccgttagatttggatctgatgatgaacagtaaccattcaggtcaaggaaatgatcaaaaagatgatgttcgtttaaagctcgagcttaaaatccatgcctcttctttagctcaacaggtgagtgatctcttcaatagttttgccaacaagctctttcatggactgaccagagtttacttccatgcaggatgtttctggaaaagagaagaaagtaagcttgacaaccactgcaagctcatcgaatagttactcattatctcaagctgttcaagatagttcccccggtaccgtaaatgacatgttgaagccataa

SEQ ID NO: 1167 - DNA, 1104 bp, Arabidopsis thaliana
  G777 DNA sequence used for BLAST
atggatcaaccaatgaaaccaaaaacttgctctgaatctgattttgctgatgattcctctgcttcttcttcttcttcttcgggacaaaatctcaggttttagtgcttaaagatgttaactttacatggctgtgtcatgtttattcatagtttcgtctaattacagaggagctgagatggtggtggaagtgaagaaggaagcagtttgttcccagaaagcagagcgagagaagcttcgtagagataagcttaaggaacagtttcttgagcttggaaatgcacttggtatatatcttttcacaagatgaatacagattttcaaaattttctttgaattgagtttagagtaatggtttctttctacagatccgaataggcctaagagtgacaaagcctcagttctcactgatacaatacaaatgctcaaggatgtaatgaaccaagttgatagactaaaagctgagtatgaaacactatctcaagagtctcgtgaggtgatttgattaactttgtccattctcttattggatttatagttgaatatgctctgctcaagtgctcatcttccagttcgtttgatcagctaattcaagagaagagtgagctgagagaggagaaagcgactttaaagtctgatatcgagattcttaatgctcaatatcagcatagaatcaaaaccatggttccatgggtacctcattacagttatcatatccccttcgtagccataactcagggtcagtccagttttataccttattcagcctctgtcaatcctctaaccgaacaacaagcatcggttcagcagcattcttcttcttctgccgatgcttcaatgaaacaagattccaaaatcaagccgttagatttggatctgatgatgaacagtaaccattcaggtcaaggaaatgatcaaaaagatgatgttcgtttaaagctcgagcttaaaatccatgcctcttctttagctcaacaggtgagtgatctcttcaatagttttgccaacaagctctttcatggactgaccagagtttacttccatgcaggatgtttctggaaaagagaagaaagtaagcttgacaaccactgcaagctcatcgaatag

SEQ ID NO: 1168 - DNA, 1389 bp, Arabidopsis thaliana; identical to SEQ ID NO: 40
  G778 cDNA Sequence

SEQ ID NO: 1169 - protein, 399 aa, Arabidopsis thaliana
  G778 Amino Acid Sequence
MSQCVPNCHIDDTPAAATTTVRSTTAADIPILDYEVAELTWENGQLGLHGLGPPRVTASSTKYSTGAGGTLESIVDQATRLPNPKPTDELVPWFHHRSSRAAMAMDALVPCSNLVHEQQSKPGGVGSTRVGSCSDGRTMGGGKRARVAPEWSGGGSQRLTMDTYDVGFTSTSMGSHDNTIDDHDSVCHSRPQMEDEEEKKAGGKSSVSTKRSRAAAIHNQSERKRRDKINQRMKTLQKLVPNSSKTDKASMLDEVIEYLKQLQAQVSMMSRMNMPSMMLPMAMQQQQQLQMSLMSNPMGLGMGMGMPGLGLLDLNSMNRAAASAPNIHANMMPNPFLPMNCPSWDASSNDSRFQSPLIPDPMSAFLACSTQPTTMEAYSRMATLYQQMQQQLPPPSNPK

SEQ ID NO: 1170 - DNA, 2700 bp, Arabidopsis thaliana
  G778 Genomic Sequence
tataccgcgggataaaaactagtattatatgttagcgaatcctactaaactatgacaacaaatatacatgcgagtcgtatacagaattgattctcacatttaagctgtcaacaaaacattcaacaagtcttaagcaagccattaaagaagggacctgaacaatttaatatatatggttaactatttaagtatcatgtccccacttgtccattacgtgattactacaaaagttcacataaaagttcctttttatatatataggaaagggaagaagatctcaataacacaaaaccttttaaactagtaaaatacacagattttaggatgagccaatgtgttccaaactgtcacatcgatgatactccggcagcagccaccaccaccgtccgctccaccacagccgcagacatccccatgtacataccttaatttatcatcttgatagtataagtggccacaatataatgatagcttttcttgtttgtctacagattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacaggcaagtcatcatatatattaacttgttctagttattgatgtctctagctttataagtaaatgataataattaaggaaaaacgatagatggaggacgaagaagagaagaaagccggaggaaaatcatcagtttcaaccaagagaagcagagctgctgctattcataaccaatccgaacgtgtaatgattcactcaaccattattttatttttcaaaaaaagttttatgttattcgtctactgttacacatgcatgaccccctgcgttttatccttggttgattttattacagaagaggagagataaaatcaatcaaaggatgaagactttgcaaaaactggttcccaattccagcaaggtacgcaagtcgttttacataaactagtgtacgtggctaaataaaagtcatatgcgtacgtatagtaaaaaaatagatgctagctaggtatacatgaaaatagaggggataatatgaaaaagggtggtggaccaaagtgaagtgaatgcatctaaagaaatggacctcatacgatgattctactccacacacttatgttcatcaatctcttatttgcttgtcccctaaaaacttattttacatcactttattacttggtccggttggtccattcatatacacctttaattattatatgccttgtggctgtcgactcaaaaatcaacacaatctacattacacacatgctccgtaacattggtttggttaattatagtagataccaaagaggcttgatatataaatcgttaattttggaactatagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcaggttgaccctttttctatatatagatatacaacttgggtctaaacaatgcttcagtaccatttatatttttatatatttggaattgcagccaacgacgatggaagcgtatagcaggatggctacattatatcagcaaatgcaacaacaacttcctcctccttcgaatccaaaatgattattactcaaacacctctatatagtttacgtctatatatgtgttagtcacatacatacatatatatattccatcataattatttatttatatgtataggcttctcatgaattatgatattatacgtattacgtactttaaaaatatgtggtcgtaattggatagagaaaaataaataatggttatgtttgagtgaattagtaacatcactccacgtctccaccacatccacaaatgaactccaaattttctagatcaatatacgaacagtagataatccttcgttttcacgaatttaattatgtgactgaggataagtgaaaagtggaaatggagtagacacaatagcatatgctttgtctgcaaaattccacaataatttgttgataa

SEQ ID NO: 1171 - DNA, 1955 bp, Arabidopsis thaliana
  G778 DNA sequence used for BLAST
atgatactccggcagcagccaccaccaccgtccgctccaccacagccgcagacatccccatgtacataccttaatttatcatcttgatagtataagtggccacaatataatgatagcttttcttgtttgtctacagattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacaggcaagtcatcatatatattaacttgttctagttattgatgtctctagctttataagtaaatgataataattaaggaaaaacgatagatggaggacgaagaagagaagaaagccggaggaaaatcatcagtttcaaccaagagaagcagagctgctgctattcataaccaatccgaacgtgtaatgattcactcaaccattattttatttttcaaaaaaagttttatgttattcgtctactgttacacatgcatgaccccctgcgttttatccttggttgattttattacagaagaggagagataaaatcaatcaaaggatgaagactttgcaaaaactggttcccaattccagcaaggtacgcaagtcgttttacataaactagtgtacgtggctaaataaaagtcatatgcgtacgtatagtaaaaaaatagatgctagctaggtatacatgaaaatagaggggataatatgaaaaagggtggtggaccaaagtgaagtgaatgcatctaaagaaatggacctcatacgatgattctactccacacacttatgttcatcaatctcttatttgcttgtcccctaaaaacttattttacatcactttattacttggtccggttggtccattcatatacacctttaattattatatgccttgtggctgtcgactcaaaaatcaacacaatctacattacacacatgctccgtaacattggtttggttaattatagtagataccaaagaggcttgatatataaatcgttaattttggaactatagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcaggttgaccctttttctatatatagatatacaacttgggtctaaacaatgcttcagtaccatttatatttttatatatttggaattgcagccaacgacgatggaagcgtatagcaggatggctacattatatcagcaaatgcaacaacaacttcctcctccttcgaatccaaaatga

SEQ ID NO: 1172 - DNA, 766 bp, Arabidopsis thaliana
  G779 cDNA Sequence
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 1173 - protein, 200 aa, Arabidopsis thaliana
  G779 Amino Acid Sequence
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 1174 - DNA, 603 bp, Arabidopsis thaliana
  G779 Genomic Sequence
tcagggttgggagttgtggtaataacaaaggtaagaggggttagccataggagctccaatctgagagtgaggctgaagaatcctcacctgccgtttcaagaacttggtgtaacgtatggcttcgtcgagcatggaagctgtgtccatcttcgcaccaccaggcacgatcctcttgagaattcggatcttctcgctgatcctttcccgacgccgacgagcaaccaccgtctgaggatcgtcgcttatccttacgttacggcggttcggcttagggaccgtggcagggtcgatgtctacgggctgcatgacggcgatcatgtactgcatctccttcatcgcatccatgtcttcatcgtactcttcgtcttcgtccaagtgaattagggtttcgggaggtggatctaacatgagatggtgaggatcattgagaaaagctgcgtgttcttgtgtgagaagatcattagctttgttccaatccatgaggagatggtgaggctgaggctccatcatgcttcttttggggctgtggttggatctgcttttggacgagacacaagagtcgcacactcctttctttttatacataccattttccattttcat

SEQ ID NO: 1175 - DNA, 597 bp, Arabidopsis thaliana
  G779 DNA sequence used for BLAST
tcagggttgggagttgtggtaataacaaaggtaagaggggttagccataggagctccaatctgagagtgaggctgaagaatcctcacctgccgtttcaagaacttggtgtaacgtatggcttcgtcgagcatggaagctgtgtccatcttcgcaccaccaggcacgatcctcttgagaattcggatcttctcgctgatcctttcccgacgccgacgagcaaccaccgtctgaggatcgtcgcttatccttacgttacggcggttcggcttagggaccgtggcagggtcgatgtctacgggctgcatgacggcgatcatgtactgcatctccttcatcgcatccatgtcttcatcgtactcttcgtcttcgtccaagtgaattagggtttcgggaggtggatctaacatgagatggtgaggatcattgagaaaagctgcgtgttcttgtgtgagaagatcattagctttgttccaatccatgaggagatggtgaggctgaggctccatcatgcttcttttggggctgtggttggatctgcttttggacgagacacaagagtcgcacactcctttctttttatacataccattttccat

SEQ ID NO: 1176 - DNA, 2146 bp, Arabidopsis thaliana
  G780 cDNA Sequence
agaaaataggggcaagatctgagatctctgggtgttccatgcaaaactgttatactccgccgtatatttgcatctgggtcacacttctaaaccctatcatttgacttaagaatcgatttctgaagatctgggtttcttaaaagtctttcctttttgttgggatccaaacaacaaaagaaaagaaagcagagatgaatattggtcgcctagtgtggaacgaggacgataaagcgattgttgcgtcattactgggcaaacgagctctcgattacttgctttccaactctgtttccaatgctaatctcttgatgactctaggaagcgacgagaatctgcagaacaagctctcggatctcgtcgagagacccaacgcttctaatttctcttggaactacgccattttctggcagatttccaggtcaaaggccggagatttggttctctgttggggcgatggatattgcagagagcctaaagaaggagagaaatcagagatcgttaggattctaagtatgggaagagaagaagaaacgcatcagactatgagaaagagagtattgcaaaagcttcatgatttgtttggtggctcagaagaagagaactgtgctttaggactagatagagttactgacactgagatgtttcttctttcttctatgtatttctcattccctcgaggtgaaggtggtccaggcaagtgttttgcctctgctaaacctgtttggttatccgatgtcgtcaattcgggttctgattattgcgttagatcgtttcttgctaaatctgctggcattcagactgttgttttggttcctactgatcttggtgttgttgagttaggctcaacttcatgtttgcctgaaagtgaagactcaatcttgtctataagatcattgtttaccagtagtttgcctccggttagagctgttgctttacctgttactgtagctgaaaagattgatgataacagaacgaagatattcggcaaggatttgcacaattcagggtttcttcaacatcatcagcatcaccaacaacaacaacaacaaccaccgcaacagcaacagcatagacagtttagagagaaactcacggttagaaaaatggatgatagagctcccaagagattagatgcttatccgaataatgggaacaggtttatgttttcgaacccaggcaccaacaacaacactcttctgagtcctacttgggttcaacctgagaactacacgaggccaatcaacgtgaaggaagttccaagcacggatgagttcaagtttttacctttgcagcaatcatcgcagaggctgcttcctcctgctcaaatgcagatagatttctctgctgcgagttcaagggcttcagagaataattcagatggagaaggaggaggggaatgggcagatgcagtgggtgctgatgaatctggtaacaacagaccaagaaaacgcggaaggagacctgccaacggaagagcggaagctttgaaccatgtagaagcagagaggcagaggcgtgagaagcttaaccagaggttttacgctctgagatccgttgttcccaacatatccaagatggacaaagcgtccttgttgggagacgcggtttcttatataaacgagcttcacgcgaagctaaaggtcatggaagcagagagagagaggttagggtatagctcaaatccacctatcagcttggattcagatataaatgttcaaacctcaggtgaagatgtcacagtgaggataaactgtccgttggagtctcatccggcttccagaatcttccatgcgtttgaagagagtaaagtagaagtgataaactcgaacctggaagtttctcaggacacagtgttgcatacgtttgtagtcaaatctgaagaattaacgaaagagaagctgatatcggccttgtctagagagcaaacaaattcagttcagtcaagaacatcatcaggtagatagccttttgagagacagaagaaggtggaagtaagtttgtaatcaagaaccggttttgaatggttcttttttttcttctaggtatcttttgtttttacctttttttggttatatacctgtaagaatcctccaaactaggattttagaagttttattgacaaaagtagacattatcatttagaaaa

SEQ ID NO: 1177 - protein, 590 aa, Arabidopsis thaliana
  G780 Amino Acid Sequence
MNIGRLVWNEDDKAIVASLLGKRALDYLLSNSVSNANLLMTLGSDENLQNKLSDLVERPNASNFSWNYAIFWQISRSKAGDLVLCWGDGYCREPKEGEKSEIVRILSMGREEETHQTMRKRVLQKLHDLFGGSEEENCALGLDRVTDTEMFLLSSMYFSFPRGEGGPGKCFASAKPVWLSDVVNSGSDYCVRSFLAKSAGIQTVVLVPTDLGVVELGSTSCLPESEDSILSIRSLFTSSLPPVRAVALPVTVAEKIDDNRTKIFGKDLHNSGFLQHHQHHQQQQQQPPQQQQHRQFREKLTVRKMDDRAPKRLDAYPNNGNRFMFSNPGTNNNTLLSPTWVQPENYTRPINVKEVPSTDEFKFLPLQQSSQRLLPPAQMQIDFSAASSRASENNSDGEGGGEWADAVGADESGNNRPRKRGRRPANGRAEALNHVEAERQRREKLNQRFYALRSVVPNISKMDKASLLGDAVSYINELHAKLKVMEAERERLGYSSNPPISLDSDINVQTSGEDVTVRINCPLESHPASRIFHAFEESKVEVINSNLEVSQDTVLHTFVVKSEELTKEKLISALSREQTNSVQSRTSSGR

SEQ ID NO: 1178 - DNA, 1773 bp, Arabidopsis thaliana
  G780 Genomic Sequence
atgaatattggtcgcctagtgtggaacgaggacgataaagcgattgttgcgtcattactgggcaaacgagctctcgattacttgctttccaactctgtttccaatgctaatctcttgatgactctaggaagcgacgagaatctgcagaacaagctctcggatctcgtcgagagacccaacgcttctaatttctcttggaactacgccattttctggcagatttccaggtcaaaggccggagatttggttctctgttggggcgatggatattgcagagagcctaaagaaggagagaaatcagagatcgttaggattctaagtatgggaagagaagaagaaacgcatcagactatgagaaagagagtattgcaaaagcttcatgatttgtttggtggctcagaagaagagaactgtgctttaggactagatagagttactgacactgagatgtttcttctttcttctatgtatttctcattccctcgaggtgaaggtggtccaggcaagtgttttgcctctgctaaacctgtttggttatccgatgtcgtcaattcgggttctgattattgcgttagatcgtttcttgctaaatctgctggcattcagactgttgttttggttcctactgatcttggtgttgttgagttaggctcaacttcatgtttgcctgaaagtgaagactcaatcttgtctataagatcattgtttaccagtagtttgcctccggttagagctgttgctttacctgttactgtagctgaaaagattgatgataacagaacgaagatattcggcaaggatttgcacaattcagggtttcttcaacatcatcagcatcaccaacaacaacaacaacaaccaccgcaacagcaacagcatagacagtttagagagaaactcacggttagaaaaatggatgatagagctcccaagagattagatgcttatccgaataatgggaacaggtttatgttttcgaacccaggcaccaacaacaacactcttctgagtcctacttgggttcaacctgagaactacacgaggccaatcaacgtgaaggaagttccaagcacggatgagttcaagtttttacctttgcagcaatcatcgcagaggctgcttcctcctgctcaaatgcagatagatttctctgctgcgagttcaagggcttcagagaataattcagatggagaaggaggaggggaatgggcagatgcagtgggtgctgatgaatctggtaacaacagaccaagaaaacgcggaaggagacctgccaacggaagagcggaagctttgaaccatgtagaagcagagaggcagaggcgtgagaagcttaaccagaggttttacgctctgagatccgttgttcccaacatatccaagatggacaaagcgtccttgttgggagacgcggtttcttatataaacgagcttcacgcgaagctaaaggtcatggaagcagagagagagaggttagggtatagctcaaatccacctatcagcttggattcagatataaatgttcaaacctcaggtgaagatgtcacagtgaggataaactgtccgttggagtctcatccggcttccagaatcttccatgcgtttgaagagagtaaagtagaagtgataaactcgaacctggaagtttctcaggacacagtgttgcatacgtttgtagtcaaatctgaagaattaacgaaagagaagctgatatcggccttgtctagagagcaaacaaattcagttcagtcaagaacatcatcaggtagatag

SEQ ID NO: 1179 - DNA, 1778 bp, Arabidopsis thaliana
  G780 DNA sequence used for BLAST
ctatctacctgatgatgttcttgactgaactgaatttgtttgctctctagacaaggccgatatcagcttctctttcgttaattcttcagatttgactacaaacgtatgcaacactgtgtcctgagaaacttccaggttcgagtttatcacttctactttactctcttcaaacgcatggaagattctggaagccggatgagactccaacggacagtttatcctcactgtgacatcttcacctgaggtttgaacatttatatctgaatccaagctgataggtggatttgagctataccctaacctgtctctctctgcttccatgcacctattatcttcgcgacgagcctcgctcatatcaagaccccgcgtctcccaatttttttctttttgtccatcttggatatgttgggaacaacggatctcagagcgtaaaacctctggttaagcttctcacgcctctgcctctctgcttctacatggttcaaagcttccgctcttccgttggcaggtctccttccgcgttttcttggtctgttgttaccagattcatcagcacccactgcatctgcccattcccctcctccttctccatctgaattattctctgaagcccttgaactcgcagcagagaaatctatctgcatttgagcaggaggaagcagcctctgcgatgattgctgcaaaggtaaaaacttgaactcatccgtgcttggaacttccttcacgttgattggcctcgtgtagttctcaggttgaacccaagtaggactcagaagagtgttgttgttggtgcctgggttcgaaaacataaacctgttcccattattcggataagcatctaatctcttgggagctctatcatccatttttctaaccgtgagtttctctctaaactgtctatgctgttgctgttgcggtggttgttgttgttgttgttggtgatgctgatgatggtgaacaaaccctgaattgtgcaaatccttgccgaatatcttcgttctgttatcatcaatcttttcagctacagtaacaggtaaagcaacagctctaaccggaggcaaactactggcaaacaatgatcttatagacaagattgagtcttcactttcaggcaaacatgaagttgagcctaactcaacaacaccaagatcagtaggaaccaaaacaacagtctgaatgccagcagatttagcaagaaacgatctaacgcaataatcagaacccgaattgacgacatcggataaccaaacaggtttagcagaggcaaaacacttgcctggaccaccttcacctcgagggaatgagaaatacatagaagaaagaagaaacatctcagtgtcagtaactctatctagtcctaaagcacagttctcttcttctgagccaccaaacaaatcatgaagcttttgcaatactctctttctcatagtctgatgcgtttcttcttctcttcccatacttagaatcctaacgatctctgatttctctccttctttaggctctctgcaatatccatcgccccaacagagaaccaaatctccggcctttgacctggaaatctgccagaaaatggcgtagttccaagagaaattagaagcgttgggtctctcgacgagatccgagagcttgttctgcagattctcgtcgcttcctagagtcatcaagagattagcattggaaacagagttggaaagcaagtaatcgagagctcgtttgcccagtaatgacgcaacaatcgctttatcgtcctcgttccacactaggcgaccaatattcat

SEQ ID NO: 1180 - DNA, 1283 bp, Arabidopsis thaliana
  G782 cDNA Sequence
cgaggaggctagagaatcgagaatcgatcttcgccgaaccaccttgtcttctcttagctcatcgaatctctccgtcgccgtcgattcttcccgccggtgaatctctgccttattgttttcttcaatttgatcgtcctgaattcatcgtcctatttagggtttcgatcacaatctgaagaggaggtcatggacgtttctgctagaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacaaactgaaatctgagtacaccgcattgacagatgagtcccgcgagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaatgattcgaaagaatctgatgttgatcatctcaagtatccaagtatcgtttcgatgagtactgtatatagtgcgagtacaaaatgcacttagctgtttaaagcagtgttttgatgcaccgtggcattcgttttcctcggatagtcatttctcagatgattttcatccttaataggtctgctttagttctaaaactcggatgatttgtaatttccagtgtccaaatctactaattttattaaaaaaa

SEQ ID NO: 1181 - protein, 284 aa, Arabidopsis thaliana
  G782 Amino Acid Sequence
MDVSARKSQKAGREKLRREKLNEHFVELGNVLDPERPKNDKATILTDTVQLLKELTSEVNKLKSEYTALTDESRELTQEKNDLREEKTSLKSDIENLNLQYQQRLRSMSPWGAAMDHTVMMAPPPSFPYPMPIAMPPGSIPMHPSMPSYTYFGNQNPSMIPAPCPTYMPYMPPNTVVEQQSVHIPQNPGNRSREPRAKVSRESRSEKAEDSNEVATQLELKTPGSTSDKDTLQRPEKTKRCKRNNNNNSIEESSHSSKCSSSPSVRDHSSSSSVAGGQKPDDAK

SEQ ID NO: 1182 - DNA, 1285 bp, Arabidopsis thaliana
  G782 Genomic Sequence
atggacgtttctgctagaaagtcacaaaaagctgggcgcgaaaagttgaggagggaaaaactgaatgagcattttgttgaactgggaaatgtactcggtatagactcaatggttatgtggatttttctaaacagcagatgatctcactttgatcctcacatagctcttctgtttgcagatccagagagacccaagaatgacaaagccacgattctgactgatactgttcagttgttgaaagagctcacatctgaagtcaacaaactgaaatctgagtacaccgcattgacagatgagtcccgcgaggttcgtaccttatcccttacgctccaggcttttcctaacagaaaaaattagcagtctacatgacgtaaagatatcgatagggatcccaatatagataactcattgtctttttgcttttacgatatggtgactacacctatttcgtaagatgcaaactcagacgggctatataatgtaactgcttataggacttgttgttatcatcaatagcaacacttacaaatttactggtacttgtataacaacggttctttctgtagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggtagagagacttaaaactagaagctagagatctccaatttttttcggatttattatcttcacagttattcgcgaaattgtattttgaaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaatga

SEQ ID NO: 1183 - DNA, 1285 bp, Arabidopsis thaliana; identical to SEQ ID NO: 1182
  G782 DNA sequence used for BLAST

SEQ ID NO: 1184 - DNA, 1027 bp, Arabidopsis thaliana
  G783 cDNA Sequence
gtctacagtttccgacgagattctcaccggagaaagaaaggtgacttgacagagaatcttgttctgtaataaaagcaaagatggtatcgaaaactccttctacatcgtctgatgaagcaaatgctactgcagatgaaagatgtagaaaaggtaaagtaccgaaaaggatcaacaaggccgttcgtgagaggcttaagcgtgagcatttgaatgagcttttcattgaattagccgatactcttgaactgaatcaacagaacagtgggaaagcttctatactatgcgaagctactcgattcttgaaggacgtgtttggtcaaattgagtctcttagaaaggagcatgcttctctcctatctgaatctagctatgtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaacccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctcaaaaaaaaaaaaaaaaaaa

SEQ ID NO: 1185 - protein, 240 aa, Arabidopsis thaliana
  G783 Amino Acid Sequence
MVSKTPSTSSDEANATADERCRKGKVPKRINKAVRERLKREHLNELFIELADTLELNQQNSGKASILCEATRFLKDVFGQIESLRKEHASLLSESSYVTTEKNELKEETSVLETEISKLQNEIEARANQSKPDLNTSPAPEYHHHHYQQQHPERVSQFPGLPIFQGPGFQQSATTLHPPATVLVLPIQPDPQTQDISEMTQAQQPLMFNSSNVSNPCPRYASAADSWSSRLLGERLKASE

SEQ ID NO: 1186 - DNA, 1067 bp, Arabidopsis thaliana
  G783 DNA sequence used for BLAST
atggtatcgaaaactccttctacatcgtctgatgaagcaaatgctactgcagatgaaaggtgattcttaaggagacaattcttggaaatagattatggaaccttttatttttatttatggggattgattatgtttggtgtataaaacagatgtagaaaaggtaaagtaccgaaaaggatcaacaaggccgttcgtgagaggcttaagcgtgagcatttgaatgagcttttcattgaattagccgatactcttggtaaatttctcatctttccgtagatttgaatgaacaattgctcgagtgtgttgtgatattttgaatgtgattgtgatatctaactgtgaacatgtttctttgttgcagaactgaatcaacagaacagtgggaaagcttctatactatgcgaagctactcgattcttgaaggacgtgtttggtcaaattgagtctcttagaaaggagcatgcttctctcctatctgaatctagctatgtaagtcaatttctatatgcacattgattgtgtttatgtattctgtgacgtgaatcaacaactaagacgaatgttgcttcaagaagttacttcatctttgtatttttctaaatggtcttgttgatggaaactggtgttgtgtgtaggtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaagccatgtccaaggtatgctagcgcggctgactcgtggtcttctcggctacttggagagcggctgaaagccagtgaatga

SEQ ID NO: 1187 - DNA, 1201 bp, Arabidopsis thaliana
  G784 cDNA Sequence
ctcggacaaagctgaaatccctaaagaaaaaacacttctccaaacttttcatctccgatatctctttaactaacatgtcgaataatcaagctttcatggaattgggatggagaaacgacgtcggatcacttgctgtgaaagatcagggcatgatgtcagaaagagcaagaagtgatgaagatcgtctaatcaacggtctaaaatggggctacggctactttgatcatgatcaaactgataattatcttcagattgttccagagattcataaagaagtagaaaatgcgaaggaggatttattggttgttgtccctgatgaacattctgaaactgatgatcatcatcatattaaagatttttcagagagatcagatcatcgattttatctgagaaacaaacatgagaaccccaaaaaacgtcgtatccaggtcttaagtagtgatgatgaatcggaggagtttacaagagaagttccttcagttactcgaaaaggttccaagagaagaagaagagacgagaagatgagtaataagatgcgtaagctacagcaactcgtacctaattgtcacaagacggacaaggtttcggttctcgacaagaccatagagtatatgaaaaaccttcaacttcaacttcagatgatgtcaacagtgggggtgaatccttattttcttccggcgacattaggatttggaatgcacaaccacatgctgacggcaatggcttcggctcacggcctaaatccggcgaatcacatgatgccatcgccgctaattccggcgttaaattggccattaccaccgtttactaatatttcattcccacattcatctagtcaatctctatttcttacaacatcatcaccagcttcttctcctcagtctcttcacggtttggttccttatttcccaagtttcttggatttttcttcccatgcgatgagaagactatgataagtaagtagctcgataaaagtttatgtgaaatgatcgttgactaattaagagagaaaagagttccaaattaggacagtttgtgtgaaccatttgtgtcatatacttttttttccgggtggttttgtatattaataataatcaataagttaaaactttttgtataaattcttgcatgtaacaatttttttcatttatctgatattttgtaaaatatattgagacatgcttataagagcaaaaaaaaa

SEQ ID NO: 1188 - protein, 292 aa, Arabidopsis thaliana
  G784 Amino Acid Sequence
MSNNQAFMELGWRNDVGSLAVKDQGMMSERARSDEDRLINGLKWGYGYFDHDQTDNYLQIVPEIHKEVENAKEDLLVVVPDEHSETDDHHHIKDFSERSDHRFYLRNKHENPKKRRIQVLSSDDESEEFTREVPSVTRKGSKRRRRDEKMSNKMRKLQQLVPNCHKTDKVSVLDKTIEYMKNLQLQLQMMSTVGVNPYFLPATLGFGMHNHMLTAMASAHGLNPANHMMPSPLIPALNWPLPPFTNISFPHSSSQSLFLTTSSPASSPQSLHGLVPYFPSFLDFSSHAMRRL

SEQ ID NO: 1189 - DNA, 1601 bp, Arabidopsis thaliana
  G784 Genomic Sequence
tcatagtcttctcatcgcatgggaagaaaaatccaagaaacttgggaaataaggaaccaaaccgtgaagagactgaggagaagaagctggtgatgatgttgtaagaaatagagattgactagatgaatgtgggaatgaaatattagtaaacggtggtaatggccaatttaacgccggaattagcggcgatggcatcatgtgattcgccggatttaggccgtgagccgaagccattgccgtcagcatgtggttgtgcattccaaatcctaatgtcgccggaagaaaataaggattcacccccactgttgacatcatctgcaattataacatcaactttgattacaacttagtttctgaatataaatagcacatatacatattcgaatgatcaaaatgggtacatagttctataaaatataaaacatttagttggcactaaataatcacatgaaaagagatgaattcgaaatattaaagaaattctatagacttcaccatctaggttatctactgcctactatatatcattccatttttttcgtcactaaacaccaaaaagtggctatatttgtttgatcaatttgaaacccatattgtaaaacaataatccatatctcataagttggcgagtcagatcgaataccaagaacagtttatgtcaactagttaaattaaccaaaaaaaaactcagactattagataaacacttaaaacctcaagcctcaataattcaaatatatggaagaagaacactgaataaagtgtgaaataaaaatagtgaataaagttaaatatagacctgaagttgaagttgaaggtttttcatatactctatggtcttgtcgagaaccgaaaccttgtccgtctgaaaaccgtaaaaaagcaccacccgttatcagaattggaaacttaaggcaagatttcttcatatatgcaacggaagtagcggaaacttatacggaaaagactagacactcaatagttaaattgaaacattatatagaaggatctatatacacaccaaccttgtgacaattaggtacgagttgctgtagcttacgcatcttattactcatcttctcgtctcttcttcttctcttggaaccttttcgagtaactgaaggaacttctcttgtaaactcctccgattcatcctaaattaattaattttatttatagaaagaaaaaattaaaaacagtgaaaaatgataatacataaggtaacatgaaaatatatctatgtatcgacttacatcactacttaagacctggatacgacgttttttggggttctcatgtttgtttctcagataaaatcgatgatctgatctctctgaaaaatctttaatatgatgatgatcatcagtttcagaatgttcatcagggacaacaaccaataaatcctccttcgcattttctacttctttatgaatctctggaacaatctgaagataattatcagtttgatcatgatcaaagtagccgtagccccattttagaccgttgattagacgatcttcatcacttcttgctctttctgacatcatgccctgatctttcacagcaagtgatccgacgtcgtttctccatcccaattccat

SEQ ID NO: 1190 - DNA, 1753 bp, Arabidopsis thaliana
  G784 DNA sequence used for BLAST
tcatagtcttctcatcgcatgggaagaaaaatccaagaaacttgggaaataaggaaccaaaccgtgaagagactgaggagaagaagctggtgatgatgttgtaagaaatagagattgactagatgaatgtgggaatgaaatattagtaaacggtggtaatggccaatttaacgccggaattagcggcgatggcatcatgtgattcgccggatttaggccgtgagccgaagccattgccgtcagcatgtggttgtgcattccaaatcctaatgtcgccggaagaaaataaggattcacccccactgttgacatcatctgcaattataacatcaactttgattacaacttagtttctgaatataaatagcacatatacatattcgaatgatcaaaatgggtacatagttctataaaatataaaacatttagttggcactaaataatcacatgaaaagagatgaattcgaaatattaaagaaattctatagacttcaccatctaggttatctactgcctactatatatcattccatttttttcgtcactaaacaccaaaaagtggctatatttgtttgatcaatttgaaacccatattgtaaaacaataatccatatctcataagttggcgagtcagatcgaataccaagaacagtttatgtcaactagttaaattaaccaaaaaaaaactcagactattagataaacacttaaaacctcaagcctcaataattcaaatatatggaagaagaacactgaataaagtgtgaaataaaaatagtgaataaagttaaatatagacctgaagttgaagttgaaggtttttcatatactctatggtcttgtcgagaaccgaaaccttgtccgtctgaaaaccgtaaaaaagcaccacccgttatcagaattggaaacttaaggcaagatttcttcatatatgcaacggaagtagcggaaacttatacggaaaagactagacactcaatagttaaattgaaacattatatagaaggatctatatacacaccaaccttgtgacaattaggtacgagttgctgtagcttacgcatcttattactcatcttctcgtctcttcttcttctcttggaaccttttcgagtaactgaaggaacttctcttgtaaactcctccgattcatcctaaattaattaattttatttatagaaagaaaaaattaaaaacagtgaaaaatgataatacataaggtaacatgaaaatatatctatgtatcgacttacatcactacttaagacctggatacgacgttttttggggttctcatgtttgtttctcagataaaatcgatgatctgatctctctgaaaaatctttaatatgatgatgatcatcagtttcagaatgttcatcagggacaacaaccaataaatcctccttcgcattttctacttctttatgaatctctggaacaatctgaagataattatcagtttgatcatgatcaaagtagccgtagccccattttagaccgttgattagacgatcttcatcacttcttgctctttctgacatcatgccctgatctttcacagcaagtgatccgacgtcgtttctccatcccaattccatgaaagcttgattattcgacctgccaagaaaaaagtagtaaactattagggtttacgatacaaatcattgataaattattaaagaaataaataaagagaataacaaggcaagaaacctaaactctgaaacctcctgtttaattatacttacat

SEQ ID NO: 1191 - DNA, 1515 bp, Arabidopsis thaliana
  G786 cDNA Sequence
tttcattgctaattaccaatccgttcaagtttgccaggctgaatatttcagacagttgcttaagcctgtaacgtagtctagcgtctggagttttcggaaattggggttttgagcggctatctacttttgatttcgaaaaaatttactgtgagttgttaaagagtctggtattctgaagagctgtctgtgggggagcttctggtttggggggtaagggctctggtggaaactcgtgatatctttagtatgatggccataacttgatatagcatttggttccgtgtgtcaacttagtgtagtagtaactgagcagctggaagcttacaaaggcgacaaatcggtagtagaaaatattcaagcagcttgcagtttgaggtgtacaacttgtttttctctttgcgtttccttttttacgtttgcacgggttttctgatgcagaacaatcagtttcctcacttctcagatgaagtgggtgacagaaatatgcacaacccgtatgcatcagggtcatcctatgatgctttgttcccaccatgtgcaaagttgccataccatggtgttgaacttcaaccgtctgcggtctgtccaaagaactttgtcatcttcgatcaaacatatgaccgcagccaagtgatgtaccatcctgagctgactcataagctcatgaataccccttcgttgaacaatttagcttcgacgtttcagaacgagtatgttgggggaagttatggtaactatggtaactatgagcaagaagtatcctcttcttatcaagaagatccaaatgagatcgatgctctcttgagcgcagatgaagattatgaagagaatgatgataatgaaggtgaagaggatggtggtgattcagaagaagtcagcactgctcgtacttcttccagggattatggaaacaccacagcagaatcttgttgttccagttatggttacaacaacaacaacaacaacaactcaaggaagcagagtttatcgggcagtgctagtagtagtaacaatgatgggaaaggacgtaaaaagatgaagaagatgatgggagtattgaggagaattgtccctggaggagaacagatgaatacagcttgcgttcttgatgaagctgttcagtatctcaagtcacttaaaatcgaagctcagaaacttggcgttggacatttctcaaaccaatcttgaatgctaccgatatttggttcttccatcactattgtttctcgggaggtaaatcatcggtctagcgctatctggacctttctctttattttcctccctctatactcacttccttttgttggcaggatggtatctattttatgtttgaatctctctatgtattttgctttttgtgtgttactgcttcgatgaagaagcaaggtttgaacaagtacttgtggatttgatttgagattttaatttgtatggttttactttcactgtaatcatttgactatgaactacaattatcattatgtatttgcttctacatagttttaaaaaaaaaaa

SEQ ID NO: 1192 - protein, 251 aa, Arabidopsis thaliana
  G786 Amino Acid Sequence
MQNNQFPHFSDEVGDRNMHNPYASGSSYDALFPPCAKLPYHGVELQPSAVCPKNFVIFDQTYDRSQVMYHPELTHKLMNTPSLNNLASTFQNEYVGGSYGNYGNYEQEVSSSYQEDPNEIDALLSADEDYEENDDNEGEEDGGDSEEVSTARTSSRDYGNTTAESCCSSYGYNNNNNNNSRKQSLSGSASSSNNDGKGRKKMKKMMGVLRRIVPGGEQMNTACVLDEAVQYLKSLKIEAQKLGVGHFSNQS

SEQ ID NO: 1193 - DNA, 756 bp, Arabidopsis thaliana
  G786 DNA sequence used for BLAST
tcaagattggtttgagaaatgtccaacgccaagtttctgagcttcgattttaagtgacttgagatactgaacagcttcatcaagaacgcaagctgtattcatctgttctcctccagggacaattctcctcaatactcccatcatcttcttcatctttttacgtcctttcccatcattgttactactactagcactgcccgataaactctgcttccttgagttgttgttgttgttgttgttgtaaccataactggaacaacaagattctgctgtggtgtttccataatccctggaagaagtacgagcagtgctgacttcttctgaatcaccaccatcctcttcaccttcattatcatcattctcttcataatcttcatctgcgctcaagagagcatcgatctcatttggatcttcttgataagaagaggatacttcttgctcatagttaccatagttaccataacttcccccaacatactcgttctgaaacgtcgaagctaaattgttcaacgaaggggtattcatgagcttatgagtcagctcaggatggtacatcacttggctgcggtcatatgtttgatcgaagatgacaaagttctttggacagaccgcagacggttgaagttcaacaccatggtatggcaactttgcacatggtgggaacaaagcatcataggatgaccctgatgcatacgggttgtgcatatttctgtcacccacttcatctgagaagtgaggaaactgattgttctgcat

SEQ ID NO: 1194 - DNA, 952 bp, Arabidopsis thaliana
  G787 cDNA Sequence
ccccattcgcgttcttatataaagctcacagttcgagagagacaagagaccaacgaaacgaactagagacagtttgattcgaaaatcttgtcggaaaatggaggatatcgtcgaccaagaattaagcaattactgggaacctagctccttcctccaaaacgaagacttcgaatacgacagaagctggcctttggaagaagccatttctgggtcgtatgattcgagttcgccggatggagctgcttcgtcgccggcttctaagaatattgtgtcggagagaaacagaagacagaaacttaaccagagactcttcgctcttcgatcagttgttcccaatatcactaagatggataaagcctcaataatcaaagatgctattagttacatagaaggattacaatatgaagaaaagaagctcgaagctgagatcagagaacttgaatctacaccaaagagtagccttagtttcagcaaagattttgatcgtgatttacttgttcctgtcacatccaagaagatgaagcagcttgattctggttcttccacttctctcatcgaagttctcgaattgaaggtaacattcatgggagagaggacaatggtggtgagtgtaacatgtaataagaggacagatacaatggtgaaactgtgtgaagtctttgagtcattgaatctcaaaatcctcacttccaatctcacctctttctctggcatgatcttccacactgtctttattgaggcggatgaagaagaacaagaggtgttgcggttaaaaatagaaacaggaataggagcttataatgaaactcaaagccctactttgagcatcgactctctttactaataatactttttttcttccttttttggttcattttggcttctctctttacaataatgtatgtctctcttttcatttttatgatctcctacgtttgtttgtcccacccaa

SEQ ID NO: 1195 - protein, 248 aa, Arabidopsis thaliana
  G787 Amino Acid Sequence
MEDIVDQELSNYWEPSSFLQNEDFEYDRSWPLEEAISGSYDSSSPDGAASSPASKNIVSERNRRQKLNQRLFALRSVVPNITKMDKASIIKDAISYIEGLQYEEKKLEAEIRELESTPKSSLSFSKDFDRDLLVPVTSKKMKQLDSGSSTSLIEVLELKVTFMGERTMVVSVTCNKRTDTMVKLCEVFESLNLKILTSNLTSFSGMIFHTVFIEADEEEQEVLRLKIETGIGAYNETQSPTLSIDSLY

SEQ ID NO: 1196 - DNA, 2512 bp, Arabidopsis thaliana
  G787 Genomic Sequence
atggaggatatcgtcgaccaagaattaagcaattactgggaacctagctccttcctccaaaacgaagacttcgaatacgacaggttctttctttcgtcctttttttttccttactttgctttccatcttgagattttgatatttgtttctttaaaaaaaaagaagctggcctttggaagaagccatttctgggtcgtatgattcgagttcgccggatggagctgcttcgtcgccggcttctaagaatattgtgtcggagagaaacagaagacagaaacttaaccagagactcttcgctcttcgatcagttgttcccaatatcactaaggtttctctttttccccttgttttttgtcttctaattccaggattcaaacttattatagactctgtttttgttttctgatagatggataaagcctcaataatcaaagatgctattagttacatagaaggattacaatatgaagaaaagaagctcgaagctgagatcagagaacttgaatctacaccaaagagtagccttagtttcagcaaagattttgatcgtgatttacttgttcctgtcacatccaagaagatgaagcagcttgattctggttcttccacttctctcatcgaagttctcgaagtaagtttcagttccttttttcatttagaaatcataagatttaggagaagaatttttcattgaaaattgtgtgtatttgggtgtgattgaagttgaaggtaacattcatgggagagaggacaatggtggtgagtgtaacatgtaataagaggacagatacaatggtgaaactgtgtgaagtctttgagtcattgaatctcaaaatcctcacttccaatctcacctctttctctggcatgatcttccacactgtctttattgaggtcagcatctttctctctctatctctcttgtctctctaatttgtaattagttaattactaattagaagcaatgattgcaattagtcaagagtggatagtaagctttccaagaaaaagtaaaagggaaccattcaaatagtagatatatgattgctttagtaaacttttctaaaagtctccatcaaattaatactaattatgtaataacatgatagtaatttctcttatttctcaaatctttcttaaattttaccaaagtgtattttttttttttttgtagtttatcttagctttgcagtttatttgctaatatgggtggcgttggaatttatttaactagattgtggaatataaagggattttctgtggcttaagtcttttgctcgtgtcaaatactcaaacttattttaagaataaatgtctcattcgtgacgctggcaatgagcgttgtattattactttatttgtttacctgacaatataaatatagttttacagattaattataagatttcttgatttgatactgatttagacgacatggacctttctggttgatttaaagcaagattttattgagtaaactaatgattaagttagcatcaatattccacttagtctatcttcttagttaatacaatttttttttttgttggccacttaaaatgtgttgtttattttataattttggtcactatgtacattgcatgatattgaaaactaagtaaaaagtatattcgttagttccaatatcatgcagtttttgccaatttgtgttaattaaaaagattatgaatttttatttctttttgtcaatttatgtatacttattacaaagtttttgtagttgaaaatatttcttatggttaaattaaatgtttaacgtatgggaagcttccagttgcgaccaaacatttattgggttgtgtggtttttagtttttatgtctatttttggtcccacaattattgtaatttggtccatttggtttattaaaaagaaaataatattatctctgtggtaagtagaatctgattgctttgatattaaaatattgttcaactgctcgaattaaatacaataggataagaaattatagaaatgatagaatatagctaattctgccaaatacatcatatattgtctgtctggagataataaaagatagctgattctatcaaatacctcacatagaaaaacaaacataaagagtcaataattattggatcttttagagataagattatgattgcatttgctaattttttttttttttggcagcagattgcaattgctaattaaataatagtacatgtacttgattcctttatctttaatggggggagtatgggaccagtctcttctttggctcatggctattatgtatttccatttgtagttgtactgtctcgtttaaagcattgatagaaattccttttagtaaaaaattaagaaaatataatgaaagtaactttacttaaactaaattaattttggattatttatctaacaggcggatgaagaagaacaagaggtgttgcggttaaaaatagaaacaggaataggagcttataatgaaactcaaagccctactttgagcatcgactctctttactaa

SEQ ID NO: 1197 - DNA, 2512 bp, Arabidopsis thaliana; identical to SEQ ID NO: 1196
  G787 DNA sequence used for BLAST

SEQ ID NO: 1198 - DNA, 1348 bp, Arabidopsis thaliana
  G788 cDNA Sequence
cgtcgagaagagttcactcgaccacattcacataacaaaacaaaatcatacatactccagaacaaaggaaaatttaaaatatatctccttatatactcctaaagttttctttcctttagcttcttgtttagttttattctttcaacattaacttttttttactctcttgtcaaaagagaaaaagagttcttgtaatggatgattcaagctttatggatttgatgatcgacactgacgagtatctgatcgatgactgggaatccgatttcccgatatgcggggaaactaacaccaaccccggttccgagtctggatctggaaccgggtttgagttgctagcagaaagaccaacgaagcaaatgaaaaccaacaacaacatgaattcaacatcttcttctccgtcgtcttcttcttcttctggttctcgcacgtcacaagtgatctcatttgggtctccagacacgaaaaccaacccggtcgagacatctttgaacttctccaaccaagtaagcatggatcagaaagtggggtcgaaaagaaaagattgtgttaacaatggaggaagaagagaaccacatctattgaaagaacatgttttggctgaacgaaaacgtcgacaaaagctcaacgagcgtttgattgctctctctgctcttcttcctggcctcaaaaagacggacaaggcaacagttcttgaagatgccatcaaacatttgaaacaacttcaagagcgggtaaagaagctggaggaggagcgagtggtgaccaagaaaatggatcaatcaattatattggtgaagagatctcaagtgtatttagatgatgattcttcatcttattcttctacttgctctgctgcgtctcctctgtcttcttcttcggacgaagtttcgatcttcaaacaaacaatgcctatgatcgaagcccgagtttcagacagagatttgttgattagagtccattgtgagaagaacaaagggtgtatgattaagatcttaagttccttggagaagtttcgtcttgaagtagtcaatagcttcactttaccatttggaaattcaactctcgttataaccattctcactaagatggacaacaaattttctcgaccagttgaagaagtggtgaagaacataagagttgcgttagctgaataatattttaaaaaacgtttatgtgaatttcgcagtggttaaacgtgttagatttggtctccaattttgaccagatcactcggtttagttgaataatgagtagttggataataaaaccagatatgtgcacgaaatatgggattttgtcgtttgttgagtgcaaaagctggataggtgtgtgtacctaattatgg

SEQ ID NO: 1199 - protein, 320 aa, Arabidopsis thaliana
  G788 Amino Acid Sequence
MDDSSFMDLMIDTDEYLIDDWESDFPICGETNTNPGSESGSGTGFELLAERPTKQMKTNNNMNSTSSSPSSSSSSGSRTSQVISFGSPDTKTNPVETSLNFSNQVSMDQKVGSKRKDCVNNGGRREPHLLKEHVLAERKRRQKLNERLIALSALLPGLKKTDKATVLEDAIKHLKQLQERVKKLEEERVVTKKMDQSIILVKRSQVYLDDDSSSYSSTCSAASPLSSSSDEVSIFKQTMPMIEARVSDRDLLIRVHCEKNKGCMIKILSSLEKFRLEVVNSFTLPFGNSTLVITILTKMDNKFSRPVEEVVKNIRVALAE

SEQ ID NO: 1200 - DNA, 1464 bp, Arabidopsis thaliana
  G788 Genomic Sequence
atggatgattcaagctttatggatttgatgatcgacactgacgagtatctgatcgatgactgggaatccgatttcccgatatgcggggaaactaacaccaaccccggttccgagtctggatctggaaccgggtttgagttgctagcagaaagaccaacgaagcaaatgaaaaccaacaacaacatgaattcaacatcttcttctccgtcgtcttcttcttcttctggttctcgcacgtcacaagtgatctcatttgggtctccagacacgaaaaccaacccggtcgagacatctttgaacttctccaaccaagtaagcatggatcagaaagtggggtcgaaaagaaaagattgtgttaacaatggaggaagaagagaaccacatctattgaaagaacatgttttggctgaacgaaaacgtcgacaaaagctcaacgagcgtttgattgctctctctgctcttcttcctggcctcaaaaaggtcaacatctataaaccatctctttctgattgtactttaactatttgtgtttggtttaatatttattatatagtatattcttttataaataacccaccagaaccgtaaatatatattcggaaaaagaaactcatttttctttaaatgtaaatgtaaactccaacctcaacaaacataagaaaatcttgttcttatttacattttgaaaatgaaaatctgttttttttcttaaacgttttttttctcgtaaaaatcgtgtttaatatgataggcttgtaatttgtttgtatgtggatgccactactcataaaatccggatggtgacacaatgttctctagtaaatattgtactaaatgttttttttttttttgtgtgtgtgtgtgtagacggacaaggcaacagttcttgaagatgccatcaaacatttgaaacaacttcaagagcgggtaaagaagctggaggaggagcgagtggtgaccaagaaaatggatcaatcaattatattggtgaagagatctcaagtgtatttagatgatgattcttcatcttattcttctacttgctctgctgcgtctcctctgtcttcttcttcggacgaagtttcgatcttcaaacaaacaatgcctatgatcgaagcccgagtttcagacagagatttgttgattagagtccattgtgagaagaacaaagggtgtatgattaagatcttaagttccttggagaagtttcgtcttgaagtagtcaatagcttcactttaccatttggaaattcaactctcgttataaccattctcactaaggtatgttatcaatcttctaatatttttttatttatcatattctatctttttttatatattatcatttactgttgatttttatgtattaatgtgatttttaaatctaatttgcagatggacaacaaattttctcgaccagttgaagaagtggtgaagaacataagagttgcgttagctgaataa

SEQ ID NO: 1201 - DNA, 1464 bp, Arabidopsis thaliana; identical to SEQ ID NO: 1200
  G788 DNA sequence used for BLAST

SEQ ID NO: 1202 - DNA, 1107 bp, Arabidopsis thaliana
  G791 cDNA Sequence
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 1203 - protein, 234 aa, Arabidopsis thaliana
  G791 Amino Acid Sequence
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 1204 - DNA, 2400 bp, Arabidopsis thaliana
  G791 Genomic Sequence
tgcgcgtgaaaaccactctaatttctctggattccaagattccccaattcgtctcctccaacagttttcttcttctcttcttctttgggtgttccttccaccaacggcagaaatcgatttggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccaggtttttcttcttacttcccctttctctcttaagtgcttcaaattagggttccgatctggtttttaagaaattcaaattgatttgagtgaaatcagtgtgattgcttgaataattttatgtgggttttttctggtatgcgaaggtgtatcgttaaatcaagggaagggctaattttgttaaagtaacgaactttgtgattttaagcttgtgtgattgtttgagtaagttatagagaagaaactgagttcttattcatttgaattggtttctatgcttaaatttgggttcttttagcttgtgtagatatctttagagtgggtgaaatgatatgttaagttaggaagtttggcctcaggagaggatttaggtttgtttatctaaagtcaactgtgtgtgcctgacatgtttttagtgtaacttctgacatgttacttgattcgggaattgattgatcatatatcacttcttgttaggtgggaattagattcctttttcatggatagtgctttcacatatgagtggatggtttgaccttagcatgtcaatgttaactaattaatctgcttccttggaagtgagtagttgtaagttgctacatgattgagtatagatgtaatacttagttggttcgatgtatttcttgttggttcagtgctggagttgatggctcggctggaaactcagaagctagcaaagaacctggatccaaaaagaggtaagctttttatgttaaactctttgtgacacacctttaattcaaaagacttactgaaccaggaaactatagcaactttcagaatctataactttgagaaatcgctatggaattgtttatggttcttttgttgtggggatctgtattggctcgcttgacatattttgggcttgacaaggtatcagaaaaaataatcttgttcattccatgtctcagggggagatgtgaatcatcctctgccactagctcgaaagcatgtagagagaagcagcgacgggacaggttgaatgacaagtaagttttaacaattttgtatatccttcctttactctttagtaggtactaaaatgatcgccttttaaataaataacaggtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaaggtgaaatttgaatcctcctttatccccataaaatcatcgaatgcttactagtttccggtttatgtcaatcagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcagatcgtctctcactttatgtgttcttacattaatacatagaatgtggttacttcctcgccataagagtttgaaagtacaaaaaattagaaacaggagagaccgcaaaacatgatccggtagagaagtgaaaactccactgcagaaaagtttgctcctatatcttgatctgtgaatctcctctctgggtgccaatgtagaaaatgg

SEQ ID NO: 1205 - DNA, 1724 bp, Arabidopsis thaliana
  G791 DNA sequence used for BLAST
atggtgtcacccgaaaacgctaattggatttgtgacttgatcgatgctgattacggaagtttcacaatccaaggtcctggtttctcttggcctgttcagcaacctattggtgtttcttctaactccaggtttttcttcttacttcccctttctctcttaagtgcttcaaattagggttccgatctggtttttaagaaattcaaattgatttgagtgaaatcagtgtgattgcttgaataattttatgtgggttttttctggtatgcgaaggtgtatcgttaaatcaagggaagggctaattttgttaaagtaacgaactttgtgattttaagcttgtgtgattgtttgagtaagttatagagaagaaactgagttcttattcatttgaattggtttctatgcttaaatttgggttcttttagcttgtgtagatatctttagagtgggtgaaatgatatgttaagttaggaagtttggcctcaggagaggatttaggtttgtttatctaaagtcaactgtgtgtgcctgacatgtttttagtgtaacttctgacatgttacttgattcgggaattgattgatcatatatcacttcttgttaggtgggaattagattcctttttcatggatagtgctttcacatatgagtggatggtttgaccttagcatgtcaatgttaactaattaatctgcttccttggaagtgagtagttgtaagttgctacatgattgagtatagatgtaatacttagttggttcgatgtatttcttgttggttcagtgctggagttgatggctcggctggaaactcagaagctagcaaagaacctggatccaaaaagaggtaagctttttatgttaaactctttgtgacacacctttaattcaaaagacttactgaaccaggaaactatagcaactttcagaatctataactttgagaaatcgctatggaattgtttatggttcttttgttgtggggatctgtattggctcgcttgacatattttgggcttgacaaggtatcagaaaaaataatcttgttcattccatgtctcagggggagatgtgaatcatcctctgccactagctcgaaagcatgtagagagaagcagcgacgggacaggttgaatgacaagtaagttttaacaattttgtatatccttcctttactctttagtaggtactaaaatgatcgccttttaaataaataacaggtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaaggtgaaatttgaatcctcctttatccccataaaatcatcgaatgcttactagtttccggtttatgtcaatcagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaa

SEQ ID NO: 1206 - DNA, 1008 bp, Arabidopsis thaliana
  misc_feature (993)..(993): n is a, c, g, or t
  misc_feature (995)..(995): n is a, c, g, or t
  misc_feature (1007)..(1007): n is a, c, g, or t
  G792 cDNA Sequence
tcttttttcttccgtttttccacacattgtctctacctttccctttttcagatttgaccctttgttttcaaaagaaacgatttttagtagccgccggggaatcaggagaatggtgtctccggagaatacgaactggcttagtgattaccctttgattgaaggtgctttctctgatcagaaccccactttcccttggcagatagatggctcagctactgtcagtgttgaagtggatggcttcctttgtgatgcagatgtgatcaaagaaccaagttcaaggaagaggatcaaaactgaatcttgcactggttctaactcgaaagcttgtagggagaaacaaagacgtgatagactaaatgacaagtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaaagctgctgcttctctctactactattaacggttctgtaagattacttcttacgcgcttttttctgatgtaatgattctcacattctgtgattggtgacatagtccactgcaacttaaaatgtaaaattgaaataagcttgcactaaaaatcaaatctcattgtgcaaaaagttggataatttggaaatcattgttttacaaananaaaaccccccgng

SEQ ID NO: 1207 - protein, 226 aa, Arabidopsis thaliana
  G792 Amino Acid Sequence
MVSPENTNWLSDYPLIEGAFSDQNPTFPWQIDGSATVSVEVDGFLCDADVIKEPSSRKRIKTESCTGSNSKACREKQRRDRLNDKFTELSSVLEPGRTPKTDKVAIINDAIRMVNQARDEAQKLKDLNSSLQEKIKELKDEKNELRDEKQKLKVEKERIDQQLKAIKTQPQPQPCFLPNPQTLSQAQAPGSKLVPFTTYPGFAMWQFMPPAAVDTSQDHVLRPPVA

SEQ ID NO: 1208 - DNA, 1496 bp, Arabidopsis thaliana
  G792 Genomic Sequence
atggtgtctccggagaatacgaactggcttagtgattaccctttgattgaaggtgctttctctgatcagaaccccactttcccttggcagatagatggctcagctactgtcaggttagttttttgttaatcagattcaagggtttctgggttctgtgttttgtttctttcaccatctattagttttgtttcttggctttggacttttggtgttttaggattggtagttatatctggagaagttgttatggatgtgtgatcactcagttggtttttagatgctcttgttgtgatagagatattggacttctgcataaatcaatcctctgtttttttttttgtctccgttttgcttacgttcctctgtttcctaaagaagtagacgaatctagatctctaccaattgcgaaaggaaggttctgtaattagtatctggagaagttctttatggagtttgaccttgttgatcactcagattgctattaaatggtcttcttgtgatagaaatatgaaagaactgagaacctaaagtataatgctttttctctctgttttgcatccattcctctgtttccttaagcagtagacgaatcttgcttctattctggaattctacaaattggctgtaatctttgtaattgatccttcctcttgtgttgatgtgatctgttcacagtgttgaagtggatggcttcctttgtgatgcagatgtgatcaaagaaccaagttcaaggaagaggtatcaaacgctatttggtcaaacctgcgttaactaatgactttcttgttcttgctatgcaatattggaacctgttgtaaagttttccttcttactgctgcaggatcaaaactgaatcttgcactggttctaactcgaaagcttgtagggagaaacaaagacgtgatagactaaatgacaagtattttcttgctttctcgtcattctcttctatcatttaccttttgagttcttaatcttttggtatggtgctttgtcaataggtttacggagttgagttccgtattggaacctgggagaactccaaaaacagacaaggttgctattatcaatgatgcaattcgcatggtgaatcaagcaagagatgaagcgcagaaactaaaggacttgaactcaagcctccaggagaaaatcaaggagttgaaggtaaaaactgaaaactcctgcaagatctttagcttgtccattgatcttatgtatatgccaatatgtaggatgagaagaacgagctgcgtgatgagaaacagaagcttaaggtcgagaaggagagaatcgatcagcaactgaaagctattaagacacagcctcagcctcaaccttgtttcttaccaaatccgcaaacactctctcaagctcaagctcctggaagcaagcttgtccctttcacaacttatcccggctttgcaatgtggcaattcatgcctcctgctgctgttgatacctcacaggaccatgtccttcgtcctccagttgcttaa

SEQ ID NO: 1209 - DNA, 1496 bp, Arabidopsis thaliana
  G792 DNA sequence used for BLAST
ttaagcaactggaggacgaaggacatggtcctgtgaggtatcaacagcagcaggaggcatgaattgccacattgcaaagccgggataagttgtgaaagggacaagcttgcttccaggagcttgagcttgagagagtgtttgcggatttggtaagaaacaaggttgaggctgaggctgtgtcttaatagctttcagttgctgatcgattctctccttctcgaccttaagcttctgtttctcatcacgcagctcgttcttctcatcctacatattggcatatacataagatcaatggacaagctaaagatcttgcaggagttttcagtttttaccttcaactccttgattttctcctggaggcttgagttcaagtcctttagtttctgcgcttcatctcttgcttgattcaccatgcgaattgcatcattgataatagcaaccttgtctgtttttggagttctcccaggttccaatacggaactcaactccgtaaacctattgacaaagcaccataccaaaagattaagaactcaaaaggtaaatgatagaagagaatgacgagaaagcaagaaaatacttgtcatttagtctatcacgtctttgtttctccctacaagctttcgagttagaaccagtgcaagattcagttttgatcctgcagcagtaagaaggaaaactttacaacaggttccaatattgcatagcaagaacaagaaagtcattagttaacgcaggtttgaccaaatagcgtttgatacctcttccttgaacttggttctttgatcacatctgcatcacaaaggaagccatccacttcaacactgtgaacagatcacatcaacacaagaggaaggatcaattacaaagattacagccaatttgtagaattccagaatagaagcaagattcgtctactgcttaaggaaacagaggaatggatgcaaaacagagagaaaaagcattatactttaggttctcagttctttcatatttctatcacaagaagaccatttaatagcaatctgagtgatcaacaaggtcaaactccataaagaacttctccagatactaattacagaaccttcctttcgcaattggtagagatctagattcgtctacttctttaggaaacagaggaacgtaagcaaaacggagacaaaaaaaaaaacagaggattgatttatgcagaagtccaatatctctatcacaacaagagcatctaaaaaccaactgagtgatcacacatccataacaacttctccagatataactaccaatcctaaaacaccaaaagtccaaagccaagaaacaaaactaatagatggtgaaagaaacaaaacacagaacccagaaacccttgaatctgattaacaaaaaactaacctgacagtagctgagccatctatctgccaagggaaagtggggttctgatcagagaaagcaccttcaatcaaagggtaatcactaagccagttcgtattctccggagacaccat

SEQ ID NO: 1210 - DNA, 1420 bp, Arabidopsis thaliana
  G793 cDNA Sequence
cattctctcacctaacaactccacacaagattcttcgcatggaaagttgttcttcgacttctcttctctaactcgctatcttttaactcacccagctccactgagtcgaaaatttcaaacctttactcgtttccttcatggctaataacaacaacatcccacatgatagcatctccgatccatctcctaccgacgatttcttcgagcagatcctcgggctttccaacttctccggttcttcaggttctggtctctctggaatcggcggcgtgggtccacctccgatgatgcttcagcttggttcaggcaacgaagggaatcataatcatatgggtgccattggaggaggtggacctgtagggtttcataatcagatgtttccgttgggattaagtctcgatcaagggaaaggacatggctttcttaaacctgatgaaactggtaaacgtttccaagacgatgttcttgataatcgatgttcctctatgaaacctattttccatgggcagccaatgtcacagccagctccaccaatgccgcatcaacagtctactattcggcctagagttagggctaggcgaggtcaagctaccgatccacatagcatcgctgagaggctccgaagggaaagaatagcagaacggatcaggtcgttgcaggaacttgtacctaccgttaacaagacagatagggctgctatgatcgacgagattgtcgattatgtaaagtttctcaggctccaagttaaggtcctgagcatgagccgtcttggtggagccggtgctgtcgcaccactagtcactgaaatgccattatcttcatcagttgaggatgagacgcaggccgtgtgggagaaatggtcaaacgatgggacagagaggcaagtggctaagctgatggaagaaaacgttggagcagcgatgcaacttttgcaatcaaaggctctttgcataatgccgatctcattggcaatggcgatttaccattctcagccaccagacacatcttcttcaatcgtcaaaccagagatgaatcctccaccgtagatttttgttcatccaacggtccccagctgatgattgacattttgctctgtttcccactactagacttttgtgactcatgaaaggtaagtaaaaaggcattggagatggaatctaagtaggatttgtgcagtaaagaagtaaaacgggatctgtcaaaagaaggaaaaagctctcgcttgcttggctagtatttatcattttgatgaaagtaactcttttttgttcaaagactttagtgtgattttcaggaccaagggctttgagggtagtgctagctgtagtaatagtaatgaaggtgtgggatcgtgtttttgaattatgtaaaaaaggaagaaaaaacaaatgttggtattatattatggttttgcctgaaa

SEQ ID NO: 1211 - protein, 302 aa, Arabidopsis thaliana
  G793 Amino Acid Sequence
MANNNNIPHDSISDPSPTDDFFEQILGLSNFSGSSGSGLSGIGGVGPPPMMLQLGSGNEGNHNHMGAIGGGGPVGFHNQMFPLGLSLDQGKGHGFLKPDETGKRFQDDVLDNRCSSMKPIFHGQPMSQPAPPMPHQQSTIRPRVRARRGQATDPHSIAERLRRERIAERIRSLQELVPTVNKTDRAAMIDEIVDYVKFLRLQVKVLSMSRLGGAGAVAPLVTEMPLSSSVEDETQAVWEKWSNDGTERQVAKLMEENVGAAMQLLQSKALCIMPISLAMAIYHSQPPDTSSSIVKPEMNPPP

SEQ ID NO: 1212 - DNA, 2179 bp, Arabidopsis thaliana
  G793 Genomic Sequence
atggctaataacaacaacatcccacatgatagcatctccgatccatctcctaccgacgatttcttcgagcagatcctcgggctttccaacttctccggttcttcaggttctggtctctctggaatcggcggcgtgggtccacctccgatgatgcttcagcttggttcaggcaacgaagggaatcataatcatatgggtgccattggaggaggtggacctgtagggtttcataatcagatgtttccgttgggattaagtctcgatcaagggaaaggacatggctttcttaaacctgatgaaactggtaaacgtttccaagacgatgttcttgataatcgatgttcctctatgaaacctgtaagtttctcttcagaatcttcactttgtctttttcttttgtgttctcgagaaaataaagtgaaattcaaatctttagggtttcaaaatggtgtcgtttttgagaaaacccagcttaggtctaaatttgatagttaccgagagtttttggctcagattggtgagatttgatgtttttgaagaaacccaagttgaagattttgatgtgttttaaagtcataacactaaaattagttttgcaagaaactttagtataaaagagtgttcttttatgtccaaattatattgtaagaaaatttgctctttagtttcttttctcatgtggataattccgtcatagtttgaattgttgctataactactctagtggcgaccgttcttgtgagaagcggtttttaagcttttcttaatgttattacggcattgttttgtgttttgttgaagattttccatgggcagccaatgtcacagccagctccaccaatgccgcatcaacagtctactattcggcctagagttagggctaggcgaggtcaagctaccgatccacatagcatcgctgagagggtaagatgtttgatacactttttttatcttctggtctcttttttcgatttttatgtgataatgtttgatcaaagctttaattatagcttttggttgagaaagttcgattagttcttacttactaagaacggtaagacctaacctgaatgtatttgctttgcaacagctccgaagggaaagaatagcagaacggatcaggtcgttgcaggaacttgtacctaccgttaacaaggttggtatctttttctctagagcttcagctactgttttcatgtcgcgaagagagcttgaaagagattttaaaagtagggagaaaactagagttgtcaatgagagaaaagttttgtgattggcatatagaaactgcggtattcacatctgtttcttttgctttccttttgcagacagatagggctgctatgatcgacgagattgtcgattatgtaaagtttctcaggctccaagttaaggtaaacacccaagtcattttcagttttctattctctggtttttgaaaatgctatcattaaaagtttgtagaaagattatttaaaacagccagaaggatttagtggtgtaaatccttggtccccaccaccacctactctcttaaaccaaacttccaatcttaataaaagattataattgtttaatctggcaataaagagtaatcaaagagtacatgattgtgtgttttttggcattagtgtctttcactttttgcttgcttccctcccatggagaatcatcacaattgaggactattgtaataaagctaatgagaacattgaagaatattttatgcaatgatgggctttgataatatttttccttcataagctttatctctggtcaactatggcaggtcctgagcatgagccgtcttggtggagccggtgctgtcgcaccactagtcactgaaatgccattatcttcatcagttgaggttagactagagagagatacttcattaaaaaaagaacagaactttggtaatggtttttcttgcactgacttgtggtgtaaaaactttcttcaggatgagacgcaggccgtgtgggagaaatggtcaaacgatgggacagagaggcaagtggctaagctgatggaagaaaacgttggagcagcgatgcaacttttgcaatcaaaggctctttgcataatgccgatctcattggcaatggcgatttaccattctcagccaccagacacatcttcttcaatcgtcaaaccagagatgaatcctccaccgtag

SEQ ID NO: 1213 - DNA, 2179 bp, Arabidopsis thaliana; identical to SEQ ID NO: 1212
  G793 DNA sequence used for BLAST

SEQ ID NO: 1214 - DNA, 1410 bp, Arabidopsis thaliana
  G795 cDNA Sequence
cgaaaaaataaaagaggaatcaattttttcatatatagccaaagtcacatagtgattcttctccaatcaaatctctatcaacaatgacaagcttgcacaaaaccctcttcacacaaaatcccactactttagatcaactcatgatgtgccacacgggaagagacaattcatggaaaaaactagaaaacatagacgaagaaggtccatcgacggtggcacgtgaagtgaggacggcgttaccaccggagacgccaacggagatgatggagttcttggggagatcatggagcatttccgccgtcgaactcacgagagcttttttcaacaattccactgccgacactaactcttttcttctatctactatcgttaacaccaacaaagaagacagagaagatgaagaagattctacttccatggcttcttctcgtgaccttctgctgccacatgtgggaaataagaccagccctccaataactccaagaaccggtagagaaatgaagcatttgtacaagagcatgataagaggaagaacaatgggaagaagattaaaggatcagaaggagaagaagaaacaagagaccagaactcgcaacgctgagattcacgccgcggtctctgtcgcaggagtagctgcagttgttgccgcaaccgcagcatctaacgctattgcggccgcagaagatgcggttgaatcaacaaccgttgcagctgcaatggcatctgcagctgctctcatcgcttcacattgcatcgagatagcgggagagattggggcgggttataaccagattgccacggctgttagctccgcgaccaatgctaggactaacggagacattatggctttaacggcaagtgctgcaacagcgttgcgaggagctgcgattctaaggtcacgaatggaaaggaacaacgagaacaaagcaatgctatatgcaacaaaggagcacgtcgtagaaatggaagagagaaatgtatttggagcgatgactttcgtctctagaggagaagagcttctcaaacgcacccgcaaaggggatcttcattggaagcaagtatcttttaacatcaattccaattggcaagtggttcttaaaatgaagagcaaacatgtgggtggaactttcacgaagacgaagaaatgcgttgtcaatggagtgtgccgagatatacccgaatgggcacatagaggacgagcagataaaatggtagagcgaagagcctactttggggtgaaaacagtggaaagggtgattgaattcgaatgtggaaacaaaagagagaagcaaatgtggatagaggggattcaacagttgcttaactcactcgaaatcggttctagtgttcaatggaaacattagagttaggatcaaattaaaacactatttcacatttgaacatcatgta

SEQ ID NO: 1215 - protein, 426 aa, Arabidopsis thaliana
  G795 Amino Acid Sequence
MTSLHKTLFTQNPTTLDQLMMCHTGRDNSWKKLENIDEEGPSTVAREVRTALPPETPTEMMEFLGRSWSISAVELTRAFFNNSTADTNSFLLSTIVNTNKEDREDEEDSTSMASSRDLLLPHVGNKTSPPITPRTGREMKHLYKSMIRGRTMGRRLKDQKEKKKQETRTRNAEIHAAVSVAGVAAVVAATAASNAIAAAEDAVESTTVAAAMASAAALIASHCIEIAGEIGAGYNQIATAVSSATNARTNGDIMALTASAATALRGAAILRSRMERNNENKAMLYATKEHVVEMEERNVFGAMTFVSRGEELLKRTRKGDLHWKQVSFNINSNWQVVLKMKSKHVGGTFTKTKKCVVNGVCRDIPEWAHRGRADKMVERRAYFGVKTVERVIEFECGNKREKQMWIEGIQQLLNSLEIGSSVQWKH

SEQ ID NO: 1216 - DNA, 2818 bp, Arabidopsis thaliana
  G795 Genomic Sequence
atgacaagcttgcacaaaaccctcttcacacaaaatcccactactttagatcaacgtaagttctttttttctttcccttaattgattacgttaatcggtcaaattaatagtggatgtgtgattttgttagtcatgatgtgccacacgggaagagacaattcatggaaaaaactagaaaacatagacgaagaaggtccatcgacggtggcacgtgaagtgaggacggcgttaccaccggagacgccaacggagatgatggagttcttggggagatcatggagcatttccgccgtcgaactcacgagagcttttttcaacaattccactgccgacactaactcttttcttctatctactatcgttaacaccaacaaagaagacagagaagatgaagaagattctacttccatggcttcttctcgtgaccttgtaagtctactctcttcctattttctgaacactatttgtttagttatgaaaaattctactagatggcaacatgcactagtataaaacttgagtatataaacctactatgatactaaatgaacatcttttaaaatgtacgacgtgaagaatgagtttatctaagcttttttctattatttgcttatagcaatttaacgaaatttctacctacttaattaaaattgtaaattgctatttattctgcatattttcccttctgttttatcacacggccgctcaagtttatttttaatttgtttttgggtaaaagtaactaaactttgcgcatgaaaacttttatgtgaggtttatgtattattttttttggtttgttgctgacttgttgttgagtgttattaaagaactaaatcgattttacctaaagcgtaacttttgttataggttttattacttaaatattaatttacactttcattttcaatgctacaagaaaaagaacagaaaatttacaattctgattccatttttcagctgctgccacatgtgggaaataagaccagccctccaataactccaagaaccggtagagaaatgaaggtatatatgatctattaaaccggggggtttccggtttatcattgtctcaaatcaaatcatatctttattaaaaggagtcgacgtaaagaatgaaaaaaagctggttggtttcggaactttttcgttgattataaaaattaaccgagagaaaagagaaagcattataattgtcatgatgaaatcatgcaattgtttattcaatccatatccttttctttttgaaataataaaaagggtaacacagtgagtaatgtgcaatgagcggaaattctatggttaacttttttttacgttcgaaataattgctgacaaaaagaaggacttcatttgagaaaactcaaatataatgtcaaacatcaatttggctagatctacccgttacatgaattcggttctagttttattggatttttagattcggattaatatgttatgtctggagaatataataatatatactagtcaattagactactcctcgccaagtgactattactagatgatatattatgagaatcaaaacatatgagcaaatatgaataaaatcgttgtgaatgatacagcatttgtacaagagcatgataagaggaagaacaatgggaagaagattaaaggatcagaaggagaagaagaaacaagagaccagaactcgcaacgctgagattcacgccgcggtctctgtcgcaggagtagctgcagttgttgccgcaaccgcagcatctaacgctattgcggccgcagaagatgcggttgaatcaacaaccgttgcagctgcaatggcatctgcagctgctctcatcgcttcacattgcatcgagatagcgggagagattggggcgggttataaccagattgccacggctgttagctccgcgaccaatgctaggactaacggagacattatggctttaacggcaagtgctgcaacaggtatcatttattgttttctcgcatagtctaccgctttcaaatgataccccatatgtgattttgaggttttgttgagagattttagcgttgcgaggagctgcgattctaaggtcacgaatggaaaggaacaacgagaacaaagcaatgctatatgcaacaaaggagcacgtcgtagaaatggaagagagaaatgtatttggagcgatgactttcgtctctagaggagaagagcttctcaaacgcacccgcaaaggtaacttgtgctccaagaaaacaccgttttgatcatgtgatgaatctgtcagggttaagtttccgaggatatttggtgacaggggatcttcattggaagcaagtatcttttaacatcaattccaattggcaagtaagttttttttttttttttttaagaactttcataaaaaaatgatatatatgatgttcctcatactcataggctcttgattttgaaataggtggttcttaaaatgaagagcaaacatgtgggtggaactttcacgaagacgaagaaatgtaagcttacatgacacaagtttctagcgaattagtgaataccaaagttgatagtcttcttaattaccttgtacaaaccaacattcccttggcggtttatttggatgcaggcgttgtcaatggagtgtgccgagatatacccgaatgggcacatagaggacgagcagataaaatggtagagcgaagagcctactttggggtgaaaacagtggaaagggtgattgaattcgaatgtggaaacaaaagagagaagcaaatgtggatagaggggattcaacagttgcttaactcactcgaaatcggttctagtgttcaatggaaacattag

SEQ ID NO: 1217 - DNA, 2818 bp, Arabidopsis thaliana
  G795 DNA sequence used for BLAST
ctaatgtttccattgaacactagaaccgatttcgagtgagttaagcaactgttgaatcccctctatccacatttgcttctctcttttgtttccacattcgaattcaatcaccctttccactgttttcaccccaaagtaggctcttcgctctaccattttatctgctcgtcctctatgtgcccattcgggtatatctcggcacactccattgacaacgcctgcatccaaataaaccgccaagggaatgttggtttgtacaaggtaattaagaagactatcaactttggtattcactaattcgctagaaacttgtgtcatgtaagcttacatttcttcgtcttcgtgaaagttccacccacatgtttgctcttcattttaagaaccacctatttcaaaatcaagagcctatgagtatgaggaacatcatatatatcatttttttatgaaagttcttaaaaaaaaaaaaaaaaaacttacttgccaattggaattgatgttaaaagatacttgcttccaatgaagatcccctgtcaccaaatatcctcggaaacttaaccctgacagattcatcacatgatcaaaacggtgttttcttggagcacaagttacctttgcgggtgcgtttgagaagctcttctcctctagagacgaaagtcatcgctccaaatacatttctctcttccatttctacgacgtgctcctttgttgcatatagcattgctttgttctcgttgttcctttccattcgtgaccttagaatcgcagctcctcgcaacgctaaaatctctcaacaaaacctcaaaatcacatatggggtatcatttgaaagcggtagactatgcgagaaaacaataaatgatacctgttgcagcacttgccgttaaagccataatgtctccgttagtcctagcattggtcgcggagctaacagccgtggcaatctggttataacccgccccaatctctcccgctatctcgatgcaatgtgaagcgatgagagcagctgcagatgccattgcagctgcaacggttgttgattcaaccgcatcttctgcggccgcaatagcgttagatgctgcggttgcggcaacaactgcagctactcctgcgacagagaccgcggcgtgaatctcagcgttgcgagttctggtctcttgtttcttcttctccttctgatcctttaatcttcttcccattgttcttcctcttatcatgctcttgtacaaatgctgtatcattcacaacgattttattcatatttgctcatatgttttgattctcataatatatcatctagtaatagtcacttggcgaggagtagtctaattgactagtatatattattatattctccagacataacatattaatccgaatctaaaaatccaataaaactagaaccgaattcatgtaacgggtagatctagccaaattgatgtttgacattatatttgagttttctcaaatgaagtccttctttttgtcagcaattatttcgaacgtaaaaaaaagttaaccatagaatttccgctcattgcacattactcactgtgttaccctttttattatttcaaaaagaaaaggatatggattgaataaacaattgcatgatttcatcatgacaattataatgctttctcttttctctcggttaatttttataatcaacgaaaaagttccgaaaccaaccagctttttttcattctttacgtcgactccttttaataaagatatgatttgatttgagacaatgataaaccggaaaccccccggtttaatagatcatatataccttcatttctctaccggttcttggagttattggagggctggtcttatttcccacatgtggcagcagctgaaaaatggaatcagaattgtaaattttctgttctttttcttgtagcattgaaaatgaaagtgtaaattaatatttaagtaataaaacctataacaaaagttacgctttaggtaaaatcgatttagttctttaataacactcaacaacaagtcagcaacaaaccaaaaaaaataatacataaacctcacataaaagttttcatgcgcaaagtttagttacttttacccaaaaacaaattaaaaataaacttgagcggccgtgtgataaaacagaagggaaaatatgcagaataaatagcaatttacaattttaattaagtaggtagaaatttcgttaaattgctataagcaaataatagaaaaaagcttagataaactcattcttcacgtcgtacattttaaaagatgttcatttagtatcatagtaggtttatatactcaagttttatactagtgcatgttgccatctagtagaatttttcataactaaacaaatagtgttcagaaaataggaagagagtagacttacaaggtcacgagaagaagccatggaagtagaatcttcttcatcttctctgtcttctttgttggtgttaacgatagtagatagaagaaaagagttagtgtcggcagtggaattgttgaaaaaagctctcgtgagttcgacggcggaaatgctccatgatctccccaagaactccatcatctccgttggcgtctccggtggtaacgccgtcctcacttcacgtgccaccgtcgatggaccttcttcgtctatgttttctagttttttccatgaattgtctcttcccgtgtggcacatcatgactaacaaaatcacacatccactattaatttgaccgattaacgtaatcaattaagggaaagaaaaaaagaacttacgttgatctaaagtagtgggattttgtgtgaagagggttttgtgcaagcttgtcat

SEQ ID NO: 1218 - DNA, 923 bp, Arabidopsis thaliana
  G798 cDNA Sequence
gcatcacttcccttaaagcttcaaccttctccgatatgccgacgtcgactccggtgaaccacggcgaatagctatgaaacctaacggcgtaacagttccgatttctgaccagcaagaacagcttccatgtcctcgttgtgactcatccaacactaagttctgttactacaacaactacaacttctctcagcctcgtcacttctgcaaagcttgtcgtcgttactggactcacggtggtactctccgtgacgttcctgtcggtggtggtactcgtaaaagcgcgaaacgttcccgcacttgctcgaactcttcttcctcctctgtttctggtgtcgtctctaactctaacggtgttccgttacaaacgacgcctgttctcttccctcagtcgtcaatctctaacggcgttactcacacagtaactgaaagcgacggaaagggaagtgctttatctctctgtggaagtttcacctccactctgttgaaccataacgctcgtgcgacggctacgcatggatccggttcggttattggtatcggaggttttggaatcggactcgggtcgggttttgatgacgtcagctttggactcggaagagcgatgtggccgttttcaactgttggtactgcgacaacgacgaatgttgggagtaacggtggtcatcacgctgttccaatgccagccacgtggcagttcgagggtttagagagcaacgctggtggtggatttgtctccggtgagtactttgcgtggccggatctttccatcacaactccgggaaactcactcaaatgagaaaagcttctgtcttcatcaaagggcttcaaagtctcttcctttttttagtctctattggtgatgttgatctcttagtttgtgtcttgtcaatttagaaacttgtcttcggaaactagaaaacaga

SEQ ID NO: 1219 - protein, 240 aa, Arabidopsis thaliana
  G798 Amino Acid Sequence
MKPNGVTVPISDQQEQLPCPRCDSSNTKFCYYNNYNFSQPRHFCKACRRYWTHGGTLRDVPVGGGTRKSAKRSRTCSNSSSSSVSGVVSNSNGVPLQTTPVLFPQSSISNGVTHTVTESDGKGSALSLCGSFTSTLLNHNARATATHGSGSVIGIGGFGIGLGSGFDDVSFGLGRAMWPFSTVGTATTTNVGSNGGHHAVPMPATWQFEGLESNAGGGFVSGEYFAWPDLSITTPGNSLK

SEQ ID NO: 1220 - DNA, 723 bp, Arabidopsis thaliana
  G798 DNA sequence used for BLAST
atgaaacctaacggcgtaacagttccgatttctgaccagcaagaacagcttccatgtcctcgttgtgactcatccaacactaagttctgttactacaacaactacaacttctctcagcctcgtcacttctgcaaagcttgtcgtcgttactggactcacggtggtactctccgtgacgttcctgtcggtggtggtactcgtaaaagcgcgaaacgttcccgcacttgctcgaactcttcttcctcctctgtttctggtgtcgtctctaactctaacggtgttccgttacaaacgacgcctgttctcttccctcagtcgtcaatctctaacggcgttactcacacagtaactgaaagcgacggaaagggaagtgctttatctctctgtggaagtttcacctccactctgttgaaccataacgctgctgcgacggctacgcatggatccggttcggttattggtatcggaggttttggaatcggactcgggtcgggttttgatgacgtcagctttggactcggaagagcgatgtggccgttttcaactgttggtactgcgacaacgacgaatgttgggagtaacggtggtcatcacgctgttccaatgccagccacgtggcagttcgagggtttagagagcaacgctggtggtggatttgtctccggtgagtactttgcgtggccggatctttccatcacaactccgggaaactcactcaaatga

SEQ ID NO: 1221 - DNA, 1009 bp, Arabidopsis thaliana
  G801 cDNA Sequence
gatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtattgtctttttggtaatgtatagaaaaattcctatgttttatgtcatcgaaagtgtttagaaagtacctctaatttgcggtttcttttgctccttttttacttaatttaagcttattgcttgtttgattagggttttagggtttaagaatatttggtctcgttaatttgtttcggagagtgatagaaagagagagagattgattgattgttgtacctaaaacgctataaaagctctgtttttactagcgaaaaaa

SEQ ID NO: 1222 - protein, 239 aa, Arabidopsis thaliana
  G801 Amino Acid Sequence
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 1223 - DNA, 720 bp, Arabidopsis thaliana
  G801 Genomic Sequence
atggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttga

SEQ ID NO: 1224 - DNA, 720 bp, Arabidopsis thaliana; identical to SEQ ID NO: 1223
  G801 DNA sequence used for BLAST

SEQ ID NO: 1225 - DNA, 1604 bp, Arabidopsis thaliana
  G802 cDNA Sequence
gctctctctctcttctcgagacaaagaagaagacaagagtcaaacttgaaggcgacaatcggagcttccatggccgtttcttcctctttcaccaaaccctaatttcaatttcatcttcttttcccttctttctcaccggaaaatggatctctccgacatccgaaacaacaacaacgacaccgccgccgtcgccaccggaggaggagcaagacagctagttgacgcatctctctcaatcgttcccagatctacacctcccgaagactcaacactcgcaacaacctcatctacggcaacggcgactacaacgaagcggtcgactaaagaccgtcacacgaaagtcgacggaagaggacgtcggattcgtatgccggcgctatgtgcagctagagtttttcagttaacgagagagttaggtcataaatccgatggtgaaactattgaatggcttcttcaacaagctgagccagctattgttgctgctacaggtacaggaactattccggcgaacttctctactttaagtgtttcgttacgaagtagtggatcgactctctctgctccgccgtcgaaatcggtgccgctttacggtgctcttggattgactcatcatcagtatgatgaacaaggaggcggcggtgtgtttgctgctcatacgtcgccgcttttagggtttcatcatcagcttcaacaccaccagaaccagaatcagaatcaagatccggtggaaactattcctgaaggtgagaatttctctaggaaacggtatagatcggttgatttgtctaaagaaaacgatgatcggaaacagaacgagaataaatctttgaaagaaagtgaaacgtcgggtcctacggcggcgccgatgtgggcggttgcgccgccgagtaggtctggtgctgggaacactttttggatgcttccggtaccgacaacggccggtaatcaaatggagagtagtagcaacaataacaccgccgcaggccaccgtgctcctcctatgtggccatttgtgaactctgctggaggaggagcgggaggtggaggcggagcagcgactcactttatggcgggaacggggtttagttttccgatggatcagtacagaggaagtccacttcagttaggttcttttttagctcagccgcagccgactcagaacttaggactaagtatgccggactcgaatctcgggatgttagccgctttgaactcggcttattcaagaggcggaaacgcaaacgcgaatgcggaacaagcgaacaatgcggtggagcatcaagagaagcagcaacagagtgatcatgatgatgatagtagagaggagaactcaaatagctctgagtgagtgatgtaaactaatcttgtgaaatcattgaatgtggtaagaaattgatttaaagcgtttgtagcggtttggttgattgttttattgtgagattttgtgtgttgttgtttagtagtgtttagacaagaacaatttatgtgtgaaggaattgttaggtttgggtccaaatggactctcatgggtagagaatgttttcaatgtatagaaggaatgatagtcttttcgatttttcagttttcaaaaaaaaaaaaaaaaa

SEQ ID NO: 1226 - protein, 401 aa, Arabidopsis thaliana
  G802 Amino Acid Sequence
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFHHQLQHHQNQNQNQDPVETIPEGENFSRKRYRSVDLSKENDDRKQNENKSLKESETSGPTAAPMWAVAPPSRSGAGNTFWMLPVPTTAGNQMESSSNNNTAAGHRAPPMWPFVNSAGGGAGGGGGAATHFMAGTGFSFPMDQYRGSPLQLGSFLAQPQPTQNLGLSMPDSNLGMLAALNSAYSRGGNANANAEQANNAVEHQEKQQQSDHDDDSREENSNSSE

SEQ ID NO: 1227 - DNA, 1503 bp, Arabidopsis thaliana
  G802 DNA sequence used for BLAST
tcactcagagctatttgagttctcctctctactatcatcatcatgatcactctgttgctgcttctcttgatgctccaccgcattgttcgcttgttccgcattcgcgtttgcgtttccgcctcttgaataagccgagttcaaagcggctaacatcccgagattcgagtccggcatacttagtcctaagttctgagtcggctgcggctgagctaaaaaagaacctaactgaagtggacttcctctgtactgatccatcggaaaactaaaccccgttcccgccataaagtgagtcgctgctccgcctccacctcccgctcctcctccagcagagttcacaaatggccacataggaggagcacggtggcctgcggcggtgttattgttgctactactctccatttgattaccggccgttgtcggtaccggaagcatccaaaaagtgttcccagcaccagacctactcggcggcgcaaccgcccacatcggcgccgccgtaggacccgacgtttcactttctttcaaagatttattctcgttctgtttccgatcatcgttttctttagacaaatcaaccgatctataccgtttcctagagaaattctcaccttcaggaatagtttccaccggatcttgattctgattctggttctggtggtgttgaagctgatgatgaaaccctaaaagcggcgacgtatgagcagcaaacacaccgccgcctccttgttcatcatactgatgatgagtcaatccaagagcaccgtaaagcggcaccgatttcgacggcggagcagagagagtcgatccactacttcgtaacgaaacacttaaagtagagaagttcgccggaatagttcctgtacctgtagcagcaacaatagctggctcagcttgttgaagaagccattcaatagtttcaccatcggatttatgacctaactctctcgttaactgaaaaactctagctgcacatagcgccggcatacgaatccgacgtcctcttccgtcgactttcgtgtgacggtctttagtcgaccgcttcgttgtagtcgccgttgccgtagatgaggttgttgcgagtgttgagtcttcgggaggtgtagatctgggaacgattgagagagatgcgtcaactagctgtcttgctcctcctccggtggcgacggcggcggtgtcgttgttgttgtttcggatgtcggagagatccattttccggtgagaaagaagggaaaagaagatgaaattgaaattagggtttggtgaaagaggaagaaacggccatggaagctccgattgtcgccttcaagtttgactcttgtcttcttctttgtctcgagaagagagagagagagatgagagaaaaaaaggtttgatgatgtaaaagcaggtggatgacttttccagcaagaggatattattattaaaataaataatatatatgccgtcattaacattaaataaaacgtttattgatttttgattagttattatataaatcaaaaagta

SEQ ID NO: 1228 - DNA, 1263 bp, Arabidopsis thaliana
  G804 cDNA Sequence
atactccaagaatttataggttataagtaaaaattcagtacaagtttgtttgtttgtttattccattttcttgtgtgtttttttccccataatttataaattttataagcaatatggagtcccacaacaacaaccagagcaacaacaacaccactggttcggcccatctggtcccatccatgggaccaatctccggttcagtctcattaaccaccactgctccaaactccactaccaccaccgtcaccgccgctaaaacacccgcaaaacgaccgtccaaggaccgtcacatcaaagtagacggacgtggccggaggatacgtatgccggctatctgcgcagcacgtgtcttccaactaacacgtgagttacaacacaaatcggacggcgagactatagagtggctgctccaacaagcggagccagctatcatcgcagccaccggaactggaaccataccggcgaatatctctactttgaacatctctcttcgaagcagtggctctactctttcagctccactgtctaaatctttccacatgggaagagcggctcaaaacgctgccgtttttgggttccagcaacagctttatcatcctcatcatatcacgacagattcttcttcttcttctcttcccaaaacattccgtgaagaagatctttttaaagatcctaattttctagatcaagaacccggttcaagatcacctaaaccgggatccgaagctcctgatcaagatccgggttcgacccggtcaagaacacaaaatatgataccgccgatgtgggcactagcgccaacgccagcctccacaaacggaggtagtgctttttggatgttaccagtcggaggaggaggaggtccggctaacgttcaggatccatcacagcacatgtgggcgtttaatccgggtcattacccgggtcgaatcgggtcggttcagctagggtctatgttagtgggaggtcaacagttagggttaggtgttgcagaaaataacaatttggggctattttccggcggaggaggagacggtggtcgggttggtctcggaatgagtcttgagcaaaagcctcaacatcaagtgagtgatcatgctactagagaccaaaatcctactatagatggttctccttgaaagacttcatgatttctttggtttttaaaaagtgtgaatgtgtgatttattgcaacttttgttgaggactccaatgttaatatgggttttagggttggcttttcgggattgccaaattgttatt

SEQ ID NO: 1229 - protein, 341 aa, Arabidopsis thaliana
  G804 Amino Acid Sequence
MESHNNNQSNNNTTGSAHLVPSMGPISGSVSLTTTAPNSTTTTVTAAKTPAKRPSKDRHIKVDGRGRRIRMPAICAARVFQLTRELQHKSDGETIEWLLQQAEPAIIAATGTGTIPANISTLNISLRSSGSTLSAPLSKSFHMGRAAQNAAVFGFQQQLYHPHHITTDSSSSSLPKTFREEDLFKDPNFLDQEPGSRSPKPGSEAPDQDPGSTRSRTQNMIPPMWALAPTPASTNGGSAFWMLPVGGGGGPANVQDPSQHMWAFNPGHYPGRIGSVQLGSMLVGGQQLGLGVAENNNLGLFSGGGGDGGRVGLGMSLEQKPQHQVSDHATRDQNPTIDGSP

SEQ ID NO: 1230 - DNA, 1026 bp, Arabidopsis thaliana
  G804 Genomic Sequence
tcaaggagaaccatctatagtaggattttggtctctagtagcatgatcactcacttgatgttgaggcttttgctcaagactcattccgagaccaacccgaccaccgtctcctcctccgccggaaaatagccccaaattgttattttctgcaacacctaaccctaactgttgacctcccactaacatagaccctagctgaaccgacccgattcgacccgggtaatgacccggattaaacgcccacatgtgctgtgatggatcctgaacgttagccggacctcctcctcctccgactggtaacatccaaaaagcactacctccgtttgtggaggctggcgttggcgctagtgcccacatcggcggtatcatattttgtgttcttgaccgggtcgaacccggatcttgatcaggagcttcggatcccggtttaggtgatcttgaaccgggttcttgatctagaaaattaggatctttaaaaagatcttcttcacggaatgttttgggaagagaagaagaagaagaatctgtcgtgatatgatgaggatgataaagctgttgctggaacccaaaaacggcagcgttttgagccgctcttcccatgtggaaagatttagacagtggagctgaaagagtagagccactgcttcgaagagagatgttcaaagtagagatattcgccggtatggttccagttccggtggctgcgatgatagctggctccgcttgttggagcagccactctatagtctcgccgtccgatttgtgttgtaactcacgtgttagttggaagacacgtgctgcgcagatagccggcatacgtatcctccggccacgtccgtctactttgatgtgacggtccttggacggtcgttttgcgggtgttttagcggcggtgacggtggtggtagtggagtttggagcagtggtggttaatgagactgaaccggagattggtcccatggatgggaccagatgggccgaaccagtggtgttgttgttgctctggttgttgttgtgggactccat

SEQ ID NO: 1231 - DNA, 1026 bp, Arabidopsis thaliana; identical to SEQ ID NO: 1230
  G804 DNA sequence used for BLAST

SEQ ID NO: 1232 - DNA, 1248 bp, Arabidopsis thaliana
  G811 cDNA Sequence
ccaccaccaacaacaaacatataaaccataaggaaaacagagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaataccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttagactttattatggttatattattattattatttattttttgtgtgtttgttcttaattattttatgtataccccaaagaaagaaagaaaataaggcagatccatagttgagtcagtagtcatcgtttgtagaaagttttgacagtatataatttctgattatatttgttaaaa

SEQ ID NO: 1233 - protein, 330 aa, Arabidopsis thaliana
  G811 Amino Acid Sequence
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSIPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 1234 - DNA, 1077 bp, Arabidopsis thaliana
  G811 DNA sequence used for BLAST
atggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgtaagttaattcataaccgaaactcatacatgaaactggaaacaggggattacgaactaatgatcctttctttatttactttaggggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttag

SEQ ID NO: 1235 - DNA, 2156 bp, Arabidopsis thaliana
  G830 cDNA Sequence
gccacgcgtccgctcttcatcggcggctagatttccgggtcctcagtatcgggtcagatctagatccggatccggagacgctgagaatgaaacacttcagaactgagcgagtccgtgcgactccgaagctcttcacctacgttctcgtcggtttcatcgctctactcggcttgacttgcctctactacggctcttcgttcgctcccggatccagaaagtccgatgagttcgatggatctaataaccgcgttcgcaccggaatcggatccttgaggaatcgagatattgtgcttgcagtgagccgtttcgaagttcctaaaagtgttccgatatgtgattcgagacactcggagttgataccgtgtttggatcggaaccttcattaccagttgaaattgaaactcaatttatcgttaatggagcactatgagcatcattgtcctccatcagaacggcgtttcaattgccttgttccgcctcctgttggttataagatcccgttaaggtggcctgtgagtagagacgaggtgtggaaggcgaatatcccgcacacacaccttgctcaagagaagtctgatcagaattggatggttgttaatggtgataagatcaattttcctggtggaggaacacatttccacaacggagctgacaaatacattgtttccctggctcagatgctgaaattccctggtgacaaactcaacaatgggggaagcattcggaatgttcttgacgttggttgtggggtagctagcttcggagcctatcttctttcacatgacatcatagccatgtctcttgcccctaatgatgtccaccagaaccagatccagtttgctctagaacgagggattccatcaacacttggtgttcttgggacaaagcggcttccatacccaagcagatcatttgaacttgctcactgctctagatgtcggatagattggcttcaaagagatgggatcttgttactggaacttgataggttgctcagacctggtggctactttgtatactcgtcgcctgaagcttatgcacacgacccagagaacagaaagattgggaatgcaatgcatgatctctttaagagaatgtgttggaaggtcgtggccaaacgagaccaatctgttatatggggaaaaccgatatccaacagctgttacttgaagagggatccgggtgtcctgcctccgctttgtccttctggagatgacccagatgcaacttggaatgtctcaatgaaggcttgcatatcaccttactcagtgaggatgcacaaagaaagatggagtggactcgttccctggccacggaggctgacagctcctccaccacgtcttgaagaaattggtgtcactcctgagcaattccgtgaagatacggaaacatggcggcttagagtgatagaatactggaaactgctgaaaccaatggtgcaaaagaactccataagaaacgtgatggacatgagctcaaaccttggcggtttcgcagctgctctaaacgataaagatgtatgggtaatgaatgtcatgcccgttcaatcctctccaagaatgaagatcatttacgaccgtggccttatcggagccactcatgattggtgtgaagcctttgacacatacccacgaacgtttgatcttatccacgcatggaacaccttcacagaaacccaagcacgtggatgcagctttgaagatctgcttatcgagatggatcggatactacgcccagaaggatttgtcataattcgtgacacaactgacaatattagctatatcaagaagtatctgacattattgaaatgggataaatggtccacagagacaactccaaaaggtgatcctctgtcgaccaaagacgagatagttttgatcgccagaaagaaactttggagcttgcccgccatttcagtgtcctgaaatctaacagtcaacaggcgaatgaatgagatttacagcatcagaggcgcgtagctgaggaaaatactcagcaatggagaagtgtaaattacacgacattcatacatagttgttaacttgttatgcatttgttgtaggaaactgcaaaatcttcttattttgcgattttcatgttcctctttataattaaaatctgcttttgtgagaaaaataaattgcttgattaatatg

SEQ ID NO: 1236 - protein, 612 aa, Arabidopsis thaliana
  G830 Amino Acid Sequence
MKHFRTERVRATPKLFTYVLVGFIALLGLTCLYYGSSFAPGSRKSDEFDGSNNRVRTGIGSLRNRDIVLAVSRFEVPKSVPICDSRHSELIPCLDRNLHYQLKLKLNLSLMEHYEHHCPPSERRFNCLVPPPVGYKIPLRWPVSRDEVWKANIPHTHLAQEKSDQNWMVVNGDKINFPGGGTHFHNGADKYIVSLAQMLKFPGDKLNNGGSIRNVLDVGCGVASFGAYLLSHDIIAMSLAPNDVHQNQIQFALERGIPSTLGVLGTKRLPYPSRSFELAHCSRCRIDWLQRDGILLLELDRLLRPGGYFVYSSPEAYAHDPENRKIGNAMHDLFKRMCWKVVAKRDQSVIWGKPISNSCYLKRDPGVLPPLCPSGDDPDATWNVSMKACISPYSVRMHKERWSGLVPWPRRLTAPPPRLEEIGVTPEQFREDTETWRLRVIEYWKLLKPMVQKNSIRNVMDMSSNLGGFAAALNDKDVWVMNVMPVQSSPRMKIIYDRGLIGATHDWCEAFDTYPRTFDLIHAWNTFTETQARGCSFEDLLIEMDRILRPEGFVIIRDTTDNISYIKKYLTLLKWDKWSTETTPKGDPLSTKDEIVLIARKKLWSLPAISVS

SEQ ID NO: 1237 - DNA, 2650 bp, Arabidopsis thaliana
  G830 DNA sequence used for BLAST
atgaaacacttcagaactgagcgagtccgtgcgactccgaagctcttcacctacgttctcgtcggtttcatcgctctactcggcttgacttgcctctactacggctcttcgttcgctcccggatccagaaagtccgatgagttcgatggatctaataaccgcgttcgcaccggaatcggatccttgaggaatcgagatattgtgcttgcagtgagccgtttcgaagttcctaaaagtgttccggttcgtgaatcgaatcatttgtttcgaattgagtagagatgtctagatttttagtgttcaagttaagatttgtgtagattagctcgttgaatttaggtttctcatgtagtggttgtactcattttgatcctgtgcagatatgtgattcgagacactcggagttgataccgtgtttggatcggaaccttcattaccagttgaaattgaaactcaatttatcgttaatggagcactatgagcatcattgtcctccatcagaacggcgtttcaattgccttgttccgcctcctgttggttataaggtcagaactctgtctgtgttgcatatgttatggctctagtgttgtggttaatgatgattttgttttatggagtttttcagatcccgttaaggtggcctgtgagtagagacgaggtgtggaaggcgaatatcccgcacacacaccttgctcaagagaagtctgatcagaattggatggttgttaatggtgataagatcaattttcctggtggaggaacacatttccacaacggagctgacaaatacattgtttccctggctcaggttcgtaccattatcatcatttggttcctctatccttttttgagtatcaagggtagagctcgaatctttagaacaactgtgcatctttcgctttatttttgttaccaatgttgctttagccagtgaacgtcaatggtataagggtatagcagtatgcaacattattgattgacactatttgactagaagatgtatagcgttgtccatttataccaaaaattatgtgggatattctgttgctcctataccgagcatagttgttttggctctgttttttattttcaagttcttctttcagatgacaaaaaaaactgcttattgctttagatgctgaaattccctggtgacaaactcaacaatgggggaagcattcggaatgttcttgacgttggttgtggggtagctagcttcggagcctatcttctttcacatgacatcatagccatgtctcttgcccctaatgatgtccaccagaaccagatccagtttgctctagaacgagggattccatcaacacttggtgttcttgggacaaagcggcttccatacccaagcagatcatttgaacttgctcactgctctagatgtcggatagattggcttcaaagagatgggatcttgttactggaacttgataggttgctcagacctggtggctactttgtatactcgtcgcctgaagcttatgcacacgacccagagaacagaaagattgggaatgcaatgcatgatctctttaagagaatgtgttggaaggtcgtggccaaacgagaccaatctgttatatggggaaaaccgatatccaacagctgttacttgaagagggatccgggtgtcctgcctccgctttgtccttctggagatgacccagatgcaacttggaatgtctcaatgaaggcttgcatatcaccttactcagtgagtaagtatccgcatcctatttcaaacttatataatatcaagtttcactaagtttgttattcattccatgtttgttatatttacccagggatgcacaaagaaagatggagtggactcgttccctggccacggaggctgacagctcctccaccacgtcttgaagaaattggtgtcactcctgagcaattccgtgaagatacggtatttcctctctcctacagcgaaagctctttttgagtccagagcttgagaacttatatttcaaaactgacatgcatctcaacatccaaatacttctttattggagtgtaggaaacatggcggcttagagtgatagaatactggaaactgctgaaaccaatggtgcaaaagaactccataagaaacgtgatggacatgagctcaaaccttggcggtttcgcagctgctctaaacgataaagatgtatgggtaatgaatgtcatgcccgttcaatcctctccaagaatgaagatcatttacgaccgtggccttatcggagccactcatgattggtatgtaaatgacttgatctcgaaacattgtgcataatccatatgatgttaaacgaaattcccttgcaggtgtgaagcctttgacacatacccacgaacgtttgatcttatccacgcatggaacaccttcacagaaacccaagcacgtggatgcagctttgaagatctgcttatcgagatggatcggatactacgcccagaaggatttgtcataattcgtgacacaactgacaatattagctatatcaagaagtatctgacattattgaaatgggataaatggtccacagagacaactccaaaaggtgatcctctgtcgaccaaagacgagatagttttgatcgccagaaagaaactttggagcttgcccgccatttcagtgtcctga

SEQ ID NO: 1238 - DNA, 2307 bp, Arabidopsis thaliana
  G832 DNA sequence used for BLAST
atgaatccatcacaacaacacttaccaaagctatgtcctaagcgcctattcctcttcttcactccattcttattgttctctctctattacatcctcaccactatcaaaaccatcaccatctcttcccaagatcgtcaccatcctccacagcttcatgtaccttccatttcccattactactcccttccagaaacttcagaaaaccgatcgtcaccacctccactactactaccaccaccaccatcatcctcatcatcgttatcttcttactttccactctgtcccaagaacttcaccaactacttgccttgccacgatccatcaacagcacgacagtacagcattgagagacactatcggagagagaggcactgtcctgacatagcccaagagaagttcaggtgtttggtcccaaagcccactggctacaaaacgccttttccatggcctgagagtagaaaatatgcttggtttaggaacgtaccattcaagaggctagctgagttgaaaaagactcagaattgggttagacttgaaggagaccgttttgttttcccaggaggcgggacttctttccccggtggtgtgaaggactatgttgatgtgattctgagtgttttgcctttggcttctgggagtatcaggactgttctcgatattggatgtggagtgagttcagttacatgaatagacaccagaacttgattcatcttgatattttacagcagtattactactttcgattatgatggattccatgtgttttgttggacccaaaatgtcaggtagcgagttttggagcctttttgctgaactataagattttgacaatgtccattgcaccgagggatatacatgaggctcaagttcagttcgcattagaacgtggactccctgctatgctcggtgttttaagcacttataagctgccttacccgtcgaggtcttttgacatggtccattgttctagatgccttgtcaattggacttcctatggtaatgtgtgtatttaaatagacctgtttatatgatttagttcactgtgttttgaactgcttgcttcatccactctgcttctgatactgaaagagagaacattttatccagatgggctttacttgatggaggtggatcgtgttttacgtcctgagggatactgggtgttgtctggaccccctgtagcatcaagggttaaatttaagaaccagaagagagattccaaggagttgcagaaccagatggagaaactaaatgatgtttttagaagactttgttgggagaagattgctgaaagttacccggttgtcatctggagaaagccttctaatcatttgcagtgtaggaaaagactaaaagctcttaagtttcctggattatgctcttctagtgaccctgacgctgcgtggtgacttcactttcccaaaatctaatttgctctgcatcttcaaaagcttaagcttgattcggttggatctttttattaataggtataaagagatggagccgtgcatcactcctcttccagatgttaacgacacaaacaagaccgttctcaaaaactggcctgagagactaaaccatgtgcctcgaatgaaaaccgggtcgatacagggaacaactattgccggcttcaaagctgacacgaacctgtggcaaagaagagttttgtactatgacaccaagtttaagtttctcagcaatggaaaatacagaaacgtcattgatatgaacgcaggattaggtggttttgctgcagctttgatcaaatatccaatgtgggttatgaatgtggttccatttgatcttaaaccgaacacactcggtgttgtgtatgatcgcggtctcattggaacttacatgaactggtaaatcactcaaaacgtctctgatatcatctaatttgacatctcttataccatattttccggtttttgtaggtgtgaagctttatctacataccctcgaacctatgacctgattcatgccaatggtgtattcagtttgtacttggacaagtaagatccgtccctaacttgaaaactttgatttacattcatttggtgatcaaagtgtaatggtttctttttctttgtttcttatgatagatgtgacattgttgatatactcttggagatgcagaggattcttagaccagaaggagcagttataatacgagaccgttttgatgttcttgtcaaagtgaaagccataaccaatcaaatgagatggaatgggacaatgtatccagaagataatagtgttttcgatcatggaacaatactaatcgtagataactcaattaaataa

SEQ ID NO: 1239 - DNA, 2306 bp, Arabidopsis thaliana
  G849 cDNA Sequence
ccccccaaaaaaaaataactcgagaattcttcatttcttttaaatcttagaatctggagtttttgtataaatcgattctaatttttcctttgtacattgttttatatatacataaaacacacaaatcgggtatgggggaatttgggttttaagatagcgtgatctgtaataataagtggttcgcgatcgtgatcaagaaactggtggctgatagtgatatgcatatttgagagatggtgttcaagagaaagttagattgcctttccgtgggatttgattttcccaacattcccagagctcctcgttcatgcaggaggaaggttctaaacaagaggattgatcatgatgatgataacactcagatctgtgcaattgacttactagctttggctggaaagattctacaggaaagcgagagttcctctgcgtcttctaatgcatttgaagaaattaagcaagagaaagtagaaaattgcaagactattaaatctgagtcttctgaccaaggaaactctgtgtcaaagcctacttatgatatctctactgagaagtgtgtggtgaacagttgtttttcatttccggatagtgacggcgttttggagcggactccgatgtctgattacaagaagattcatggtttgatggatgtagggtgtgaaaacaagaatgtaaataatgggttcgagcaaggagaagcaaccgatcgcgtgggtgatggaggcttagtcactgatacttgcaacttagaggatgcaactgcgttaggtctgcagtttccgaaatcagtctgtgtgggtggtgatttaaaatcaccatccaccttggatatgacccctaatggttcctatgctagacatgggaaccatactaacctaggtagaaaagatgatgatgaaaaattctatagttaccataaacttagcaataaatttaagtcgtataggtgtccaacaattcgaagaataagaaagtccatgtcgtccaaatactggaaacaagttccaaaagattttggatacagtagagctgatgtgggtgtgaagactctttatcgcaaaagaaaatcatgttatggttacaacgcatggcagcgtgagatcatttataagagaagaagatcacctgacagaagctcggtcgtaacttctgatggaggactcagtagtggaagtgtttccaagttacccaagaagggagatacagtaaagctaagcattaagtcctttaggattccagagctttttattgaagttccagaaactgcaacagtaggatcactaaagaggactgtgatggaggctgtcagtgttttactcagcggaggaatacgtgttggggtgttaatgcatgggaagaaggttagagatgaaaggaaaactctgtcccagactgggatctcatgtgatgaaaatctagacaaccttgggttcaccttggagcctagtcccagcaaagttcccctacctttgtgttctgaagatcctgctgtgccaaccgaccctacaagtttgtctgaacggtctgcggcgtctcctatgctagattctggaattccacatgcagatgacgtgattgattcaagaaatattgtggacagtaacctcgaattagttccatatcagggtgacatatctgttgatgaaccttcatcagattcaaaagagcttgtcccacttccagagttggaagtcaaggcgcttgccatagttccgttgaaccagaaacctaagcgtactgagctagcccagaggagaactaggagacccttctctgtgacagaggtagaagctcttgtacaagcagttgaggaactcgggactggaagatggcgtgatgtaaaattgcgtgctttcgaggatgcagatcatcggacttacgtggacttgaaggacaaatggaagacgctagttcacacagcaagtatatccccacagcaacgaagaggagagccggtgccacaagaactgctagacagagtcttgagggcatacgggtattggtcgcagcaccaaggaaaacatcaggcgagaggagcgtccaaagatccagacatgaacagaggtggagcttttgaatcaggtgtttcagtgtaaaaaaggaggtacgcattggtgggtgggtgtacagaagcaaacaacacaataaatggacaactcaatttctgcaaagtttaattgtctttatttctcgtttttttttttttttctcctacatacacttttttttttcttgctttggcatctgtaaatgactccaactgggatgagattcgtccctaaccaaatttttaggttctatcaaaaaaa

SEQ ID NO: 1240 - protein, 619 aa, Arabidopsis thaliana
  G849 Amino Acid Sequence
MVFKRKLDCLSVGFDFPNIPRAPRSCRRKVLNKRIDHDDDNTQICAIDLLALAGKILQESESSSASSNAFEEIKQEKVENCKTIKSESSDQGNSVSKPTYDISTEKCVVNSCFSFPDSDGVLERTPMSDYKKIHGLMDVGCENKNVNNGFEQGEATDRVGDGGLVTDTCNLEDATALGLQFPKSVCVGGDLKSPSTLDMTPNGSYARHGNHTNLGRKDDDEKFYSYHKLSNKFKSYRCPTIRRIRKSMSSKYWKQVPKDFGYSRADVGVKTLYRKRKSCYGYNAWQREIIYKRRRSPDRSSVVTSDGGLSSGSVSKLPKKGDTVKLSIKSFRIPELFIEVPETATVGSLKRTVMEAVSVLLSGGIRVGVLMHGKKVRDERKTLSQTGISCDENLDNLGFTLEPSPSKVPLPLCSEDPAVPTDPTSLSERSAASPMLDSGIPHADDVIDSRNIVDSNLELVPYQGDISVDEPSSDSKELVPLPELEVKALAIVPLNQKPKRTELAQRRTRRPFSVTEVEALVQAVEELGTGRWRDVKLRAFEDADHRTYVDLKDKWKTLVHTASISPQQRRGEPVPQELLDRVLRAYGYWSQHQGKHQARGASKDPDMNRGGAFESGVSV

SEQ ID NO: 1241 - DNA, 2577 bp, Arabidopsis thaliana
  G849 DNA sequence used for BLAST
ttacactgaaacacctgattcaaaagctccacctctgttcatgtctggatctttggacgctcctctcgcctgatgttttccttggtgctgcgaccaatacccgtatgccctcaagactctgtctagcagttcttgtggcaccggctctcctcttcgttgctgtggggatatacttgctgtgtgaactagcgtcttccatttgtcctgcatattcacatgttcttgagatattaacctgactgtaagacgtgatatgttccagattacatgtttgtgtctgatgtgtttaccttcaagtccacgtaagtccgatgatctgcatcctcgaaagcacgcaattttacatcacgccatctgtgtgatcagatatatcgaccattagcttttgagctttgacattatcccacgaccaaactacatgagttatgaaagaactagtgttatataccttccagtcccgagttcctcaactgcttgtacaagagcttctacctctgtcacagagaagggtctcctagttctcctctgggctagctcagtacgcttaggtttctggttcaacggaactatggcaagcgccttgacttccaactctggaagtgggacaagctcttttgaatctgatgaaggttcatcaacagatatgtcaccctgatatggaactaattcgaggttactgtccacaatatttcttgaatcaatcacgtcatctgcatgtggaattccagaatctagcataggagacgccgcagacctgggatgataattcagaaccgcttttgcttaggaatcttcaagaagaatgaacaccagtgatattcaactaaagcagcacaaggatatgatagcgaatttcttagtaccgttcagacaaacttgtagggtcggttggcacagcaggatcttcagaacacaaaggtaggggaactttgctgggactaggctccaaggtgaacccaaggttgtctagattttcatcacatgagatcccagtctgggacagagttttcctttcatctctaaccttcttcccatgcattaacaccccaacacgtattcctccgctgagtaaaacactgacagcctccatcacagtcctctgcaaccaaaagggtcaaagagcaaaatggtaatttgttaacacctcaatgtccacacaagagaaccaaacaaatgtgaagaaatacatattggcatatacctttagtgatcctactgttgcagtttctggaacttcaataaaaagctctggaatcctaaaggacttaatgcttagctttactgcaccagagataaaaatacatgagaaccacattatcctgtctccggataaatgtctcagtatcatttaccatccagtcaagtaccatgggagccttttgagaggaccacaacagctaagataagataactgaagagttttgagatagactacaataaccacctgtatctcccttcttgggtaacttggaaacacttccactactgagtcctccatcagaagttacgaccgagcttctgtcaggtgatcttcttctcttataaatgatctcacgctgccatgcgttgtaaccataacatgattttcttttgcgataaagagtcttcacacccacatctagacatccatgtttaaagtaagaacagggtgaatcacaaaaagaagaaatgtgttcaaagataagtgaagcaggctgtgttatacttaccagctctactgtatccaaaatcttttggaacttgtttccagtatttggacgacatggactttcttattcttcgaattgttggagacctatacgacttaaatttattgctaagtttatggtaactatagaatttttcatcatcatcttttctacctaggttagtatggttcccatgtctagcataggaaccattaggggtcatatccaaggtggatggtgattttaaatcaccacccacacagactgatttcggaaactgcagacctaacgcagttgcatcctctaagttgcaagtatcagtgactaagcctccatcacccacgcgatcggttgcttctccttgctcgaacccattatttacattcttgttttcacaccctacatccatcaaaccatgaatcttcttgtaatcagacatcggagtccgctccaaaacgccgtcactatccggaaatgaaaaacaactgttcaccacacacttctcagtagagatatcataagtaggctttgacacagagtttccttggtcagaagactcagatttaatagtcttgcaattttctactttctcttgcttaatttcttcaaatgcattagaagacgcagaggaactctcgctttcctgtagaatctttccagccaaagctagtaagtcaattgcacagatctgagtgttatcatcatcatgatcaatcctcttgtttagaaccttcctctggaaaaaaagattcatcagaaggcaaattcatgacattgagctaacagatccagatgaatcaaaatttaccctgcatgaacgaggagctctgggaatgttgggaaaatcaaatcccacggaaaggcaatctaactttctcttgaacaccat

SEQ ID NO: 1242 - DNA, 1210 bp, Arabidopsis thaliana
  misc_feature (1194)..(1196): n is a, c, g, or t
  G860 cDNA Sequence
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttgtcacccttccgttgcattttagcttcccatccaaatcaatttgtaaaatgtgagttagtttgcagcatgaaagctgattaaatatcagtcccgttatcacaagaggtaaaaaannnaaaaaaaaaaaaaa

SEQ ID NO: 1243 - protein, 240 aa, Arabidopsis thaliana
  G860 Amino Acid Sequence
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 1244 - DNA, 2962 bp, Arabidopsis thaliana
  G860 Genomic Sequence
atgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccaggtaccttttttcttttctctttggttgactttttttttgggtcttggtccatctaattggttgattgattgatgtagcaaattctaaatctcgatttttttttttctttcttaagtcgatttcttgttaattgtttgcaaattcaattgctttagagaaggaatcgtagatcaacttagtctgataatttgcagaagaaatcacttggtttgaatgataatatgttttgtaaggggaatatgagagtgtgttctctgtgttgttggagatgattacgatatttgtgtggaacatagattgtgagggacttgtggtgtttattgaaacatactaaatttggtagaaactttatcagaagaggaaaggaggggagaaagtggttagtggttgaagaaaactctaaactctagagaggatttagaaagaatcgtctccttttcactgttcatttactttattggcaactagttggtgggtttgatgtacctaaaatgagctgcattatcttctcttaatatatattgttagtacacaagtgggggaatcatttctgatttcgttgtcatccataatcaagtttttgtttttttaattcttcaacttggtcatttgttaatgatatgtaggagtatagtctttctttttgggaacattttgcgatttgttagaaaaatattatatcttcaatcctttctgaatttctactttaggagttcattcatttctttatttgattgtatctttcgtgtttacataattgtttattaaaaaaggttgaataaaatctggctcttagatctgtttcagagggagaaagcttccattgttctgcagagcttttgttgtttctctgttttttgaactgagactctgtttttttctttttttctcttcaataaagacagcaagatatctatactgtttactgattagagttggctctatttacatcaattttgtctggcttctctcattctctgcttaaacttcatacattatgttagatttattgcgaatctgtagttggggtgctgagaatcctgttccatgtagacagagatggcttagggttaactaaatctatttaagtaagaaaatttgacactgaaagatgtaaggataaatgttgcagtggatgttgcttgggttacattacctatcaaccacactctacaactatgaaactactctcttttttggcagcatgaaatcggtcatagagagatacagcgatgccaaaggagaaaccagttcagaaaatgatcccgcttcagaaattcaggtactccttttttttgttactcctccctatggatttcaacgagtagacaaaacaagtaacatactacaacagagagactgttactcgattcttgtactaatatgttagcctattacaactcattagcatttctcaacttttaattcctctcaagctgatcctgatatctaatcagagttgcagaccataaataccaccacacatcatatgttgaagtagggtttgcagtttgctataaaacacaagtcatgccacctgaacatcagattgcatacatagtgttgcattttattttgtcaagaatccgttgtagactagataacatatttatccgaaaacaaaatacttgtttacagtttcaaacacctgaaaatcatttctactatattctagttctggcaaaaggaggctgcgattctaaagcgtcagctacataacttgcaagaaaaccaccggtatgttttgcatcctctgagtttgtcaaacactctcgatagtagtaacaactagagcagggaaatatgtactaaaatgcaaaatgataacatacgtgtagtccaaggttagaagattttgcagaacccaaaactatcctaccatttgcatttgcttagtaaggatagtcgatataaagaatagtaagccaaatggattaagagttgtatacataaacacatctaaaccatccataagaaggaaataaccaaacactttcacactccccatcgttttcttgttttgctttggtgaattaggaaatgtatatagtaactctggaaaagtatgcatattcagaagagcttgtacttgacaggcaaatgatgggggaggagctctctggactaagtgtagaagctttacagaatttggaaaatcagcttgaattgagccttcgtggcgttcgaatgaaaaaggttttgatgctgtgacaaataagtcaaattttggaaccatttagaagaagtaatggatgtactctatctacgctcttcttttgccttttgcaggatcaaatgttaatcgaagaaatacaagtacttaaccgagaggtgggactatggttactgtgatataggttttagacgttttccatagtgttggtaagcacattgctaattctttttttattcggttgcaggggaatctcgttcaccaagagaatttagacctccacaagaaagtaaacctaatgcaccaacagaacatggaactacatgaaaaggtacctttgggttttgggaagtatctgggagccaagatactctttaaaattgctagaacatttttttctttcttatctgatgataatatgtgcttattccaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataa

SEQ ID NO: 1245 - DNA, 2962 bp, Arabidopsis thaliana; identical to SEQ ID NO: 1244
  G860 DNA sequence used for BLAST

SEQ ID NO: 1246 - DNA, 1747 bp, Arabidopsis thaliana
  G864 cDNA Sequence
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 1247 - protein, 343 aa, Arabidopsis thaliana
  G864 Amino Acid Sequence
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 1248 - DNA, 1032 bp, Arabidopsis thaliana
  G864 Genomic Sequence
atggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaa

SEQ ID NO: 1249 - DNA, 1032 bp, Arabidopsis thaliana; identical to SEQ ID NO: 1248
  G864 DNA sequence used for BLAST

SEQ ID NO: 1250 - DNA, 1126 bp, Arabidopsis thaliana; identical to SEQ ID NO: 13
  G865 cDNA Sequence

SEQ ID NO: 1251 - protein, 212 aa, Arabidopsis thaliana
  G865 Amino Acid Sequence
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 1252 - DNA, 2078 bp, Arabidopsis thaliana
  G865 DNA sequence used for BLAST
atggtctccgctctcagccgtgtcatagagaatccgacagacccgccggtcaaacaagagcttgataaatcggatcaacatcaaccagaccaaggtaactaatacaataattatatcttgatcatatgacagcttaattgtttttagctagttgatgtaactttgttataataagttacacactaactaaagacttactattaataaccctttgtcgaatttttctttcttaattattatatttgggaaaaaaggaatttgtgtaggttagaattcaagttcaagttcaatgcatctttcatttaatttactttccgtaaagaactttccttcttgtttttgaattgaaccaccgatcagcatacaacgtgtctatcctcttttttaatatatacatctagatttgatttttgtttgtttgtttgtttgtttcaaagtacaagttagataatattttattgactccatgtcttaagtcgtcaaacatatatacatatggcttcttacctaactgattagagtaattttgaccacgcatgttccttttgttcattttgaaaatttagttatcttagatatcattctctatcaactttatggttgtccttttatcaatattttgaagtatttctttccacatgattaactcgtttttaagcttcgttagttagaagccaaaatatgtcaaaatgacacatacgcatggtctttatcaaaactcatgacgaattagttttaattatccttttatttcatttacactttttattatttgaatgctaagttaatcatatgtagaaacaaaaatccagttattctttctagctagataccgtaacttttatttttgggacaaaacattgaattgacgaggatttcttttgagttttgagaatgaatcttcaattgtttaaccaaatatatatgttttgctcagtattattagtttatttgtgtgaattttgatatgtcaatatgtagctgcttgactttctgaatatttcgctggtctgacagaaaaaaagaagaagaatatttcgttgcttaaaactgataaaagtaataaatatagcaatgaatcaattattcaactggattgactctattaataggaacagctttatagaaaaattgtatatatgattcaagctttgattttcggttcagtccaaatgtctagtaattacagaaaatgtaaaccacatacttgaacttcaggtttgattgcctgtatatatatttgattccatcaaaactaaaaagttaaaaatgtaattttatgagaggaatagtatatagtctatcgtgcaaagttaagtaatccacatagttgatacgttttaagtattattgtatgcatcatctttagttaaatccttcattcttttcgtctaaatcatatatattaaacaattattctcttgctataaccaatcgttgaaatcccacgtagcaataattcttctcatgcatgtagaattgcacatgcaatatgtaatttttgttttaatttcttgtttcatgttcttcaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataa

SEQ ID NO: 1253 - DNA, 1198 bp, Arabidopsis thaliana
  G866 cDNA Sequence
aaaaaaaacttgcacatcttctcagatcttcaagtttctcctctggtttctcatcatgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggcttgaagaattaattagtttggtagttttgtaatattttgagaaatagaggggttggttttgtaattttttttctataacaaaattagttttagatttttttttagtagtcttttgaatggattttaatcttactaccgagaaagaaaaaattcttactacattttcaaaaaaaaaaaaaaa

SEQ ID NO: 1254 - protein, 321 aa, Arabidopsis thaliana
  G866 Amino Acid Sequence
MTVDIMRLPKMEDQTAIQEAASQGLKSMEHLIRVLSNRPEERNVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRHHQSTMQEHVTPSVSGLVFGSA

SEQ ID NO: 1255 - DNA, 1547 bp, Arabidopsis thaliana
  G866 Genomic Sequence
atgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaaggtattgttattactccacaataaattaatcatttgtttgactagcctagtagtagttaattgtttggttcgatacggtctaaaccaatcgctcacggactcagtgaaaatatatcacgaattcagatttcaaaattctttttttgcctcgaatttgtcaatcatgaacaagtctactagttaaattaactagtctcagtaaaaaataaagaataaaaatccgggtttaatactttgtagaccggtttggtactatctaaaccaatcggtcaatgtatttagtgaaagtcaacgacagtaacttaaaccaaagtgcacgcctgacaaggacaagttagtgggtgctgtcgttttgtatagggaaagtttttacgttttaaaagtctttgtctgcccgttgacttttgctaacctgatgcatgttcacgttagtcgtgtcagcgcacgttaaatcatttcactaattacaatgttttattatttaattaacagccgaaaaaatcggatgaagagaaccgtgagagtaccggcggtaagtgcaaagatcgccgatataccaccagacgaatattcatggagaaagtatggacaaaaaccgatcaaaggctcaccacatccacggtaactatcgtacaccatcgctatccaccgttgatttatttgtgaaacattggagatctaacggttgtgatttgtttttgttgatttcaggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggcttga

SEQ ID NO: 1256 - DNA, 1547 bp, Arabidopsis thaliana
  G866 DNA sequence used for BLAST
tcaagccgaaccaaacaccaaaccactcacgctaggagttacatgctcctgcatcgtggactggtgatgacggtgctctccttcgtacgtcacaatcaacatcgttgaatcatccaaagctctttccacgtgtttcctcgctggacatcctctaaatgtactacacttgtaataacccctgaaatcaacaaaaacaaatcacaaccgttagatctccaatgtttcacaaataaatcaacggtggatagcgatggtgtacgatagttaccgtggatgtggtgagcctttgatcggtttttgtccatactttctccatgaatattcgtctggtggtatatcggcgatctttgcacttaccgccggtactctcacggttctcttcatccgattttttcggctgttaattaaataataaaacattgtaattagtgaaatgatttaacgtgcgctgacacgactaacgtgaacatgcatcaggttagcaaaagtcaacgggcagacaaagacttttaaaacgtaaaaactttccctatacaaaacgacagcacccactaacttgtccttgtcaggcgtgcactttggtttaagttactgtcgttgactttcactaaatacattgaccgattggtttagatagtaccaaaccggtctacaaagtattaaacccggatttttattctttattttttactgagactagttaatttaactagtagacttgttcatgattgacaaattcgaggcaaaaaaagaattttgaaatctgaattcgtgatatattttcactgagtccgtgagcgattggtttagaccgtatcgaaccaaacaattaactactactaggctagtcaaacaaatgattaatttattgtggagtaataacaataccttttcttgcaatggcacttgccgttgccggagccagagatcttgccggaaaagccttcagagtggtcatgttcaaagcatctcttcctgtaaggaagaccagaaagcggcggtttcccggaggaagtcactggcaccgctggagccggagcaagaaagatcgaagagcctttagagacacttccatcaccggtgatcgcagaagacatgaaagaagagttagaagatacgctaaagctctctttagcaaactcaacaacctccgagctcttggttttagcgccaaaaacgctcggtctagtgaaatctaacgtcacgctttgttgatttgcctgaacgaagctaaccggtgctggagcagagatctgagtgggagccggagttgtcactttcaccggtggaggaacggaggaggaaggaggggaatgaaccggaccacgtctaaaccgggcgtgaccggaacggttaagaagagagataactttcttgaacttagaaactgtgaaatcagtgatctcagagcaatcaacgttacgttcttcgggacggttagagaggacacgaatcaagtgttccatgctttttaagccttgtgatgcagcttcttgtatagccgtttgatcttccatcttaggtaaacgcataatatcaacggtcat

SEQ ID NO: 1257 - DNA, 1281 bp, Arabidopsis thaliana; identical to SEQ ID NO: 69
  G867 cDNA Sequence

SEQ ID NO: 1258 - protein, 344 aa, Arabidopsis thaliana
  G867 Amino Acid Sequence
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 1259 - DNA, 1035 bp, Arabidopsis thaliana
  G867 Genomic Sequence
atggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaa

SEQ ID NO: 1260 - DNA, 1035 bp, Arabidopsis thaliana
  G867 DNA sequence used for BLAST
ttacgaggcgtgaaagatgcgttgcttcttgctacacaccaacgataacatctcagtatcgttcactcttttgtttcctacgacgtcgtttcttgaactctccggtgaaatgttaactccgaacaatctcaaaacccgacccgcatctaaatctgacccggatctcgacttccacccaatgtacaactgttgatcctgaccgttagatctactgaaactaaccacgtcaccagcacgtagattcttctccttaacgaacctgctccaacctttagtcaaaacataactctgactactgttccaatacgagtaacggaacctccacactttcccgttaacgtcctcaaagttcaacaacactcctttcacggaaacgttacttgacggtaacggaaaatgtttctctgcgtgatgtttcggtataaccaaacggtttagcttcccaacgtcgcttggcgttaccgctttctcaaacagtgcctccgccgatctaaaccccgtcgtagaaacaccatcattactcaaccccgacgttaacaacgtcctagtcatgtttccgttaccattacgacgccgtttactctgctctaactcttcgttataagtatgtttcctcaacatatcaacgatctcagatttcgaatgagaattcaagaaatcgacctcgtcttcgtccatcttcacgtctttgaaatttgtgacggcgtcacggcgacggaacctgtgaaccgcgacgtcgtaggcacgagcggcttcgtcttcttcgttgaatgtcccgagccacacgcgctggtgtttctcgtaaatctgagctccccatcttccgtttggttgtggcaccacacctttgtattttgacgacggaagcttcctagattcagcttctacgccgttctctgaatctaacacaacgcttgatccgcttcccatcctgtataagttacctaccgacgactttttcgccggagttatcgccggggtttcacagatggaacctgtacttgtagtactctcatcaacgctactcgattccat

SEQ ID NO: 1261 - DNA, 1571 bp, Arabidopsis thaliana; identical to SEQ ID NO: 6
  G869 cDNA Sequence

SEQ ID NO: 1262 - protein, 324 aa, Arabidopsis thaliana
  G869 Amino Acid Sequence
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 1263 - DNA, 975 bp, Arabidopsis thaliana
  G869 Genomic Sequence
atggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcatag

SEQ ID NO: 1264 - DNA, 975 bp, Arabidopsis thaliana
  G869 DNA sequence used for BLAST
ctatgaagctgcaaaactttttaatgggcaagagatgttgataggagcaagttgatcaaggaaaccgaaactagagtcagctagctgaagatcttcaacatccgcaaagtcgaaatctggtaacgcacttggaccgttatcttcgaatccttgaatgtcatcaagcaagccgaaatcatcaaactgatcatccgcgaggaaacaatcgaagtctaggtcttgttgctcctctgccaagaaaccaaaatcagggatctgtagattagtaaagtcgaaatcgaacaacgtttccttgtttccaccagcaggaacatttggagttggagcagttggagcaacggtcgagacgtcatcagggttgttgacacaagtgagagctgatgcagaagtgtcatcttgctcaacaggaacaacaggtgaagaacgagagcattggctagtctcagatgaagaaacatcacgtttagtagtggacacatttccagcaacaatagcatcaaactcaagcttcttagcatcataagctttagcagcttcttcaagagtatcaaaagtacccaaccaagtcctagttttcttaataggatctctaatctcagcagcccatttcccccatttcctttgcctaacaccaacaggcttcttcctaggaacagcaggagaagctgacacagctatcttgccatcagttttagtactgtcctgagaagaactctcagaaggctgttcagaaacttccatagaaggaaagttaatctcacgaacgatacgtttcattttccttggcttaggaaccttaagctcttcctcatcactagaggaatcatcagtagcataaggatcattcacaataatacggactttcctcaaaggttgggtttcttgaggaagggacgatagagtgtttctcttagctctcttcttaatctcgctactaacaccactcaaagactgttcctttctaatcgcaaccat

SEQ ID NO: 1265 - DNA, 891 bp, Arabidopsis thaliana
  G872 cDNA Sequence
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattaaaaaaaaaaaaaaaaaaa

SEQ ID NO: 1266 - protein, 195 aa, Arabidopsis thaliana
  G872 Amino Acid Sequence
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 1267 - DNA, 588 bp, Arabidopsis thaliana
  G872 DNA sequence used for BLAST
tcaaaaatcccaaagaatcaaagattcatctaataaactctctcctccgtaatcttcgatgggtaaaatctctgtaaatcgatcaccaccggagaagccagagaagtcgtcggagaaggaatcaaacccgaaattcatcggaagcaaatccaaaaacgaaaaatcataatccaccgtcgatgtagcaacagatgcagatgtagaaggagactctggtcggatctcggatccgggtactaaacccgattcttcttctcccttgacaatgtcttggaatgtgttagcgaatctagcagcagcttcctgaatctccggaggcgtcaacgacttttctacggagatcgacggtggattattagggaaattgaaattagcatcgccgccgcggagacaaaattgagcggcgtcgaaagcacgcgccgccttctcgggagtgtcgtaagagcctaaccaaattcgttctctgctgtgtggaagtctgatctccgatacccattttccccatttcctcttcctcactcctttgtactttgactgcatcgccgtgtttctcttcttctcctcttccttcatcgcttgcttcaccat

SEQ ID NO: 1268 - DNA, 2603 bp, Arabidopsis thaliana
  G877 cDNA Sequence
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 1269 - protein, 687 aa, Arabidopsis thaliana
  G877 Amino Acid Sequence
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 1270 - DNA, 2322 bp, Arabidopsis thaliana
  G877 Genomic Sequence
atggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggtaagctacaagttggtttgctttctttcgatgttattatggagctattttttctgaatatctcggtgaccttgcaggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggtttgttttagcaatcgaaacaccgaatcctcgatgactcagtaaacgagactcaaaaactttttgattttacaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggttctttataatcccctcctctgttttggtctggttctgtttatatgtttatcggcaatcacaagaccaattctttttttataacgttttcataatgtttttctaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttga

SEQ ID NO: 1271 - DNA, 2322 bp, Arabidopsis thaliana; identical to SEQ ID NO: 1270
  G877 DNA sequence used for BLAST

SEQ ID NO: 1272 - DNA, 1152 bp, Arabidopsis thaliana; identical to SEQ ID NO: 14
  G881 cDNA Sequence

SEQ ID NO: 1273 - protein, 310 aa, Arabidopsis thaliana
  G881 Amino Acid Sequence
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 1274 - DNA, 1517 bp, Arabidopsis thaliana
  G881 Genomic Sequence
atggacggttcttcgtttctcgacatctctctcgatctcaacaccaatcctttctccgcaaaacttccggtaagtccggatttcgtctgatccattttcccgaaatctaagttgatttttgtatcccttcaatttctatgaactgggattttgggaattaatcatgggttcatttcaaattttcgtatttcagaagaaggaggtctcagttttggcttctactcacttaaagaggaaatggttggagcaagacgaggttagttctttcgtcgaacacttggtgtgcactaccttcgacttcatatacttgttcgaacattcagcttttatcaattctttaacttcactttagtactttacgaatcaattaagatgggtctgagtttgaatgtctttgcatcgaaatgaatcggtgatgatgtagttagtataaagtctgaaactttacataatcaatcttgtttggaacaaaaaggaagaatctttttagtaatttgatctttgtggtggtaatgaacagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttggtaagggattttgtctgtgaatcttttgattaaagagtcatatgtttgaaattgcatagagacaaatgactaagcagagtgtaactctgcagacagttaaagatggatttcaatggaggaaatacggacaaaaggttacaagagacaacccgtcacctagagcttactttagatgctcgtttgcaccgtcttgtccagtaaaaaagaaggtaatttacacacatcgagtttattgtatttatagcttcatttgtaattgtttatctctgcttgcttcttcagttgtctaatgatctgtggtattactgttcaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatga

SEQ ID NO: 1275 - DNA, 1517 bp, Arabidopsis thaliana
  G881 DNA sequence used for BLAST
tcatgttctagattgctccattaacctcccagatatagcagcagcaagagcagctgtaaatttcgaatcttttgttaacgatgacgccatttgttgaatcagaacctcttgcatcgtattatccctttcgtttttctccaacgctagtctatgacagccattaaccagatccaaagtcactgtgcttgacccaccctggcttgtagcatccccttcagaagcatttggacccaagtggttatgcgtcccttcgtatgtcgctacaagtaaagatggatcctctgcgctgcgttgtacctgaacagtaataccacagatcattagacaactgaagaagcaagcagagataaacaattacaaatgaagctataaatacaataaactcgatgtgtgtaaattaccttcttttttactggacaagacggtgcaaacgagcatctaaagtaagctctaggtgacgggttgtctcttgtaaccttttgtccgtatttcctccattgaaatccatctttaactgtctgcagagttacactctgcttagtcatttgtctctatgcaatttcaaacatatgactctttaatcaaaagattcacagacaaaatcccttaccaagcttgtgtccgatgtttcagtaggcacgtagacagtcgaaacttttgctttgttgaagctatcagtgactggtcttttacatgaaagaagctgatttttctgctcatgttgctgatgatgatgatgatgatcttcgttgctggagctgttctcagtttttccactactgagtccaataggaaagcctaagaactcatccgggtcttgttttcttttctttatcggtatatcggtctgctcgatttcagggctctggcgactctgaagcttctccaaatgattatgtagttcgttgtagctctcacagactctagctaacatctctgttagcttcttgttctctgaattaactctgtttagctcctctcgtaactcacttgcgctctgttcattaccaccacaaagatcaaattactaaaaagattcttcctttttgttccaaacaagattgattatgtaaagtttcagactttatactaactacatcatcaccgattcatttcgatgcaaagacattcaaactcagacccatcttaattgattcgtaaagtactaaagtgaagttaaagaattgataaaagctgaatgttcgaacaagtatatgaagtcgaaggtagtgcacaccaagtgttcgacgaaagaactaacctcgtcttgctccaaccatttcctctttaagtgagtagaagccaaaactgagacctccttcttctgaaatacgaaaatttgaaatgaacccatgattaattcccaaaatcccagttcatagaaattgaagggatacaaaaatcaacttagatttcgggaaaatggatcagacgaaatccggacttaccggaagttttgcggagaaaggattggtgttgagatcgagagagatgtcgagaaacgaagaaccgtccat

SEQ ID NO: 1276 - DNA, 1195 bp, Arabidopsis thaliana; identical to SEQ ID NO: 41
  G883 cDNA Sequence

SEQ ID NO: 1277 - protein, 324 aa, Arabidopsis thaliana
  G883 Amino Acid Sequence
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPSQPVNSSGKPPLAGHPYRKRCLEHEHSESFSGKVSGSAYGKCHCKKRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 1278 - DNA, 1394 bp, Arabidopsis thaliana
  G883 Genomic Sequence
atggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgttgcagcctgttaactcttccggaaaaccaccgttggctggtcatccttacagaaagagatgtctcgagcatgagcactcagagagtttctccggaaaagtctccggctccgcctacggaaagtgccattgcaagaaaaggtattgttacgtcacccacctgtcgctctaacaactactcagtgacttcagttatttaatttcaaaagtttcaacccatagttgactattaccctcgctatatcaataattaaaaaatagtctaataattcaattaggtgaacccggtttagtaatactgtcccggttatcggtctagttgctttaaatgtcgggcatgttttggtattgcgcgccgacaatgactagaaccggttgagctcaatgaataactcaagttttgaccgttgacttttggaacccaatgttttttccgttaattaatattttctatttgatttttaatgaagcaggaaaaatcggatgaagagaaccgtgagagtaccggcgataagtgcaaagatcgccgatattccaccggacgaatattcgtggaggaagtacggacaaaaaccgatcaagggctcaccacacccacggtaaatatcctacacccgtctaatatccaccgttggtatttaatttaatcgcgatctaacggtgtttatttgttttttgcgatccagtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttga

SEQ ID NO: 1279 - DNA, 1394 bp, Arabidopsis thaliana
  G883 DNA sequence used for BLAST
tcaagccgaggcaaacactaaatcattaatgcctgaagaagaaatattctcctgcatcgcggattggttatgacggtgctctccttcgtatgtcacaataagcatcgctggatcatctaatgctcgttccacgtgtttcctcgctggacatcctctgaatgtactgcacttgtagtaaccactggatcgcaaaaaacaaataaacaccgttagatcgcgattaaattaaataccaacggtggatattagacgggtgtaggatatttaccgtgggtgtggtgagcccttgatcggtttttgtccgtacttcctccacgaatattcgtccggtggaatatcggcgatctttgcacttatcgccggtactctcacggttctcttcatccgatttttcctgcttcattaaaaatcaaatagaaaatattaattaacggaaaaaacattgggttccaaaagtcaacggtcaaaacttgagttattcattgagctcaaccggttctagtcattgtcggcgcgcaataccaaaacatgcccgacatttaaagcaactagaccgataaccgggacagtattactaaaccgggttcacctaattgaattattagactattttttaattattgatatagcgagggtaatagtcaactatgggttgaaacttttgaaattaaataactgaagtcactgagtagttgttagagcgacaggtgggtgacgtaacaataccttttcttgcaatggcactttccgtaggcggagccggagacttttccggagaaactctctgagtgctcatgctcgagacatctctttctgtaaggatgaccagccaacggtggttttccggaagagttaacaggctgcaacggagcagaagcaaggaagatttttccattggagacgctgccgtctccggttatcgccgacgacatgaatgaggagtttaaagaaacactgaagttttctttggagaattccagctcggcgctcttagctttggtgccgaagatgcttggtttagagaaatcgagtgttacactagacggtggaggaacgatttgagggtgattcgtagttgttctcactatcggagcctcaggttgagtatttttaacgatctgactctgtagtttctgagatgcggcagaggaagtggagtgaaccggtccgcgtctgaaccgagcgtgaccagtacggttaaggagagaaatgacggttttgaatttagaaacggtgaagtcagtgatctcggagcagtcaacgttgtgttgttgttcgggacggttagagaggacacggatcagatgttccatactttgtaaaccttgcgatgcagcttcctgaatagccgtttgatcatctatcttagggaaacgcattagatcgacggccat

SEQ ID NO: 1280 - DNA, 2946 bp, Arabidopsis thaliana
  G886 cDNA Sequence
gaaaaagctaaactttgctctgttttttcaacaaaaaaagtgaactttgctctgttccgtccatgtccgatgatgatcggagtggaagcagaatgagatttgaagcaaacgtctagagttccgacgttatgggttgcggaggatcaaaagtagataatcaaccaatagtgattctctgtagagaacgaaaggagctgcttaaagcggcgtcgtatcatcgttctgctctcgctgtcgctcacctaacttacttccagtctctctccgacgtcggtgaagctattcaacgtttcgttgacgacgaagtcgtagctggtttttcttcttcttcttcgccggattctccagttcttacacttccgtccgacgaagggaaaccgacgaaacacaagaggatttctccttcttcaaccacctcaatttctcattccgtcatcgaagaagaagacactgatgatgattcgcatttgcatctaagctccggatccgaatccgaatcagaagttggatctaaggatcatatccaaattactagcactccagaacaagagcggtcaacggaatcatttccttccggttatcatccaacaaactatgctccaccggtttacccacctggttatccacccggttacccattcagttacccgaccggttattcatcgggtaattatcaaccgggttacccgaattacacaggtgagaatccatacggaaatcgaggaatgtattacatgaagaaatctgcgccacaatcacgaccgttcattttccaaccggagaatcatcgagtggaggagaacgcgcaatggccgtcggattctggatttagaaacacaggagtgcaacggagatcgccgtctccgttacctcctccgtcaccacctacggtttcaacttgggattttttgaatgtgtttgatacttatgattacagcaacgcccgttctcgtgcttcgggatattatccgatgggaatggcgtcaatctcaagcagtcctgattcgaaggaagttagagaaagagaagggattcctgagctagaagaagtaacagagcaagaagttatcaagcaagtgtatagacgtcccaagagaccaggattggagaaggttaaagaacacagagacgagcacaagcacaacgtttttcctgagaggaacattaacaaaagggaagttccaatgccagaacaagtcactgagagctcattggattcagagacaatttcgtctttttcaggaagtgatgtagaatcggagtttcactatgttaatggtggtgaaggaaagagtagcagcatcagttcaatcagtcatggggctgggacaaagagctcgagagaagtagaagaacagtatgggaggaaaaaaggagtgagctttgagttggaggaaacaacgagcacttcgtcttttgatgttgaatcttccaagataagtagcttatccagtttgtcgattcatgccactagggatctcagagaagttgttaaggagatcaagagtgagttcgagattgcttcttcttgtgggaaggaggttgctttgttacttgaagtcggcaagttgccttatcagcataaaaacaatggcgttaaagttatcttatccaggatcatgtatctggtagcaccatccacacggtcatcgcactctcagcccagactatcaatacgtttaacatctagaactcgaaaaatggcgaaatcatacaatggacaagatgttaatggaggcttcaatggaaacctctcatcaaccttagagaaactgtatgcgtgggaaaagaaactgtacaaggaagtcaaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttgagtagagagtgtggacttaccacatttttgcaccgttttgaagttttgttacttgcaaattagacataggtctatatagaaggaaattgttgtatagatgagttcatattcaattattggttggttagtttcccttgtaaaccgtttttaaatggtgaagaagaagatatctaaaaaaa

SEQ ID NO: 1281 - protein, 879 aa, Arabidopsis thaliana
  G886 Amino Acid Sequence
MGCGGSKVDNQPIVILCRERKELLKAASYHRSALAVAHLTYFQSLSDVGEAIQRFVDDEVVAGFSSSSSPDSPVLTLPSDEGKPTKHKRISPSSTTSISHSVIEEEDTDDDSHLHLSSGSESESEVGSKDHIQITSTPEQERSTESFPSGYHPTNYAPPVYPPGYPPGYPFSYPTGYSSGNYQPGYPNYTGENPYGNRGMYYMKKSAPQSRPFIFQPENHRVEENAQWPSDSGFRNTGVQRRSPSPLPPPSPPTVSTWDFLNVFDTYDYSNARSRASGYYPMGMASISSSPDSKEVREREGIPELEEVTEQEVIKQVYRRPKRPGLEKVKEHRDEHKHNVFPERNINKREVPMPEQVTESSLDSETISSFSGSDVESEFHYVNGGEGKSSSISSISHGAGTKSSREVEEQYGRKKGVSFELEETTSTSSFDVESSKISSLSSLSIHATRDLREVVKEIKSEFEIASSCGKEVALLLEVGKLPYQHKNNGVKVILSRIMYLVAPSTRSSHSQPRLSIRLTSRTRKMAKSYNGQDVNGGFNGNLSSTLEKLYAWEKKLYKEVKDEEKLRAIYEEKCRRLKKMDSHGAESIKIDATRAAIRKLLTKIDVCIRSVDSISSRIHKLRDEELQPQLIQLIHGLIRMWRSMLRCHQKQFQAIRESKVRSLKANTTLQNDSGSTAILDLEIELREWCISFNNWVNTQKSYVQFLSGWLTKCLHYEPEATDDGIAPFSPSQIGAPPIFIICKDWQEAMCRISGENVTNAMQGFASSLHELWEKQEEEQRVKAQSEQRDAESERSVVSKGRSESGISALDDLKVDLDSMRKRLVEERGKGKETIKLVNNASSSSLKAGLVPIFGALRKFTSEVVKAHEIVRLQHPQTSS

SEQ ID NO: 1282 - DNA, 3185 bp, Arabidopsis thaliana
  G886 Genomic Sequence
atgggttgcggaggatcaaaagtagataatcaaccaatagtgattctctgtagagaacgaaaggagctgcttaaagcggcgtcgtatcatcgttctgctctcgctgtcgctcacctaacttacttccagtctctctccgacgtcggtgaagctattcaacgtttcgttgacgacgaagtcgtagctggtttttcttcttcttcttcgccggattctccagttcttacacttccgtccgacgaagggaaaccgacgaaacacaagaggatttctccttcttcaaccacctcaatttctcattccgtcatcgaagaagaagacactgatgatgattcgcatttgcatctaagctccggatccgaatccgaatcagaagttggatctaaggatcatatccaaattactagcactccagaacaagagcggtcaacggaatcatttccttccggttatcatccaacaaactatgctccaccggtttacccacctggttatccacccggttacccattcagttacccgaccggttattcatcgggtaattatcaaccgggttacccgaattacacaggtgagaatccatacggaaatcgaggaatgtattacatgaagaaatctgcgccacaatcacgaccgttcattttccaaccggagaatcatcgagtggaggagaacgcgcaatggccgtcggattctggatttagaaacacaggagtgcaacggagatcgccgtctccgttacctcctccgtcaccacctacggtttcaacttgggattttttgaatgtgtttgatacttatgattacagcaacgcccgttctcgtgcttcgggatattatccgatgggaatggcgtcaatctcaagcagtcctgattcgaaggaagttagagaaagagaagggattcctgagctagaagaagtaacagagcaagaagttatcaagcaagtgtatagacgtcccaagagaccaggattggagaaggttaaagaacacagagacgagcacaagcacaacgtttttcctgagaggaacattaacaaaagggaagttccaatgccagaacaagtcactgagagctcattggattcagagacaatttcgtctttttcaggaagtgatgtagaatcggagtttcactatgttaatggtggtgaaggaaagagtagcagcatcagttcaatcagtcatggggctgggacaaagagctcgagagaagtagaagaacagtatgggaggaaaaaaggagtgagctttgagttggaggaaacaacgagcacttcgtcttttgatgttgaatcttccaagataagtagcttatccagtttgtcgattcatgccactagggatctcagagaagttgttaaggagatcaagagtgagttcgagattgcttcttcttgtgggaaggaggttgctttgttacttgaagtcggcaagttgccttatcagcataaaaacaatggcgttaaaggtactgtgtcttaactcgtatgttttgctagccatgatcatgcattagtttacagctagaataaaactatctgcttttgtaacccatgcgtttaaattttgcaatgttatgtcatggttacaaagtaatgctgataaacttaagtttaatggttatttgatgaattgtaatatgaacagaaatgttgaaaactctaaattccaatataatgggaaagtatcttaaattattgtggtttagactgatttgcttggtgttgaactatgaaccatgtattctgtccgcactgctttttagatgaaggtcttttttactgttttgtttggtggggttttaaatgaaaagttttgcttttcagttatcttatccaggatcatgtatctggtagcaccatccacacggtcatcgcactctcagcccagactatcaatacgtttaacatctagaactcgaaaaatggcgaaatcatacaatggacaagatgttaatggaggcttcaatggaaacctctcatcaaccttagagaaactgtatgcgtgggaaaagaaactgtacaaggaagtcaaggtattaatatttttaatatttgatgcagctttgtgtttctgaatcactaatgggaatctatatcacatatagattcttgcgtgatgttaaattgtgatttgcgtgtgatggcaggacgaagaaaagcttcgtgctatctatgaagagaagtgcaggagactaaaaaaaatggatagtcatggagcagaatctatcaagatcgatgctactcgggcagccattaggaagcttctgaccaaaatcgatgtttgtataagatcagttgattcgatttccagcagaatccataaacttagagatgaagagttgcagccacagttgatacagttaattcacgggtaaatcatctctctatattttgacatctttttacagattaagctgaaaaaactgatattttgtgttttgaaggttgataagaatgtggaggtcaatgctgaggtgccaccagaaacagtttcaggcgatcagggagagcaaggttcgatctctaaaggcgaacacaaccttacaaaatgactctggctctacagcaattcttgatcttgagatagagcttagagaatggtgcatcagcttcaacaactgggtcaacacccagaaatcatacgtccagttcctaagcggatggctcacgaaatgccttcactatgaacccgaggcaaccgatgacggaatcgctcctttctctcctagccagatcggtgcaccgcccatctttatcatttgcaaagattggcaagaagcaatgtgtagaatatctggagagaatgtgaccaatgcaatgcaaggttttgcttcaagcctacacgagctatgggagaagcaagaagaagagcaaagggtaaaagcgcaatctgagcagcgagatgcagagtcagagagaagtgtggtttcgaaaggtcggtcagagagcgggatatcagctttggatgatttgaaagtggatttagattcaatgaggaagaggctagtcgaggagagaggtaagggtaaagaaaccattaagcttgtgaacaacgcgtcttcgagcagcttaaaagctggtttagttcccattttcggggcactgagaaaattcacatcagaagttgtgaaagctcatgaaattgttaggcttcaacatcctcagacctcttcttga

SEQ ID NO: 1283 - DNA, 3185 bp, Arabidopsis thaliana; identical to SEQ ID NO: 1282
  G886 DNA sequence used for BLAST

SEQ ID NO: 1284 - DNA, 684 bp, Arabidopsis thaliana
  G891 cDNA Sequence
atgggaatcggtgaagaaagcacaaagcctatttgggggagcgtgagccacacgtcttcaggctacgctctcaacggcaaaatcatgctctcctccgtgatcgttctattcgtcgccgttattatgatcctctgcttccacagctacgcccgttggttattccgtcgtcacaaccgtcgcattcgccgccgtattcgttctcacctccgcactctctccgcctcaccccgagaccaagctctcgaccaggctgttctcgacaagattccgatcttcgtttactcctccaagaatccaccaccaccagaagagaaggaggagtgctccgtctgcttgtcggagttcgaggaagaagacgaaggccgtcttcttcctaaatgtggccactcttttcacgtcgactgcatcgatacttggttccgttccagatccacttgcccgctttgcagagctccggttcaacccccgtttcaggtcattgaaaccggttcttcttcttcttcttcgccgttgacatttccgacggagggttgcgagagagaaccgattgacctcgccggtatcattgtggatatttccagagaagttgaatttgaaggctcaaatccgggtctacccatcgaaaacggatcaaagtttccgggtagtcgggttttgtctttaaaaaggctatggagcatctga

SEQ ID NO: 1285 - protein, 227 aa, Arabidopsis thaliana
  G891 Amino Acid Sequence
MGIGEESTKPIWGSVSHTSSGYALNGKIMLSSVIVLFVAVIMILCFHSYARWLFRRHNRRIRRRIRSHLRTLSASPRDQALDQAVLDKIPIFVYSSKNPPPPEEKEECSVCLSEFEEEDEGRLLPKCGHSFHVDCIDTWFRSRSTCPLCRAPVQPPFQVIETGSSSSSSPLTFPTEGCEREPIDLAGIIVDISREVEFEGSNPGLPIENGSKFPGSRVLSLKRLWSI

SEQ ID NO: 1286 - DNA, 684 bp, Arabidopsis thaliana; identical to SEQ ID NO: 1284
  G891 Genomic Sequence

SEQ ID NO: 1287 - DNA, 684 bp, Arabidopsis thaliana; identical to SEQ ID NO: 1284
  G891 DNA sequence used for BLAST

SEQ ID NO: 1288 - DNA, 1276 bp, Arabidopsis thaliana; identical to SEQ ID NO: 15
  G896 cDNA Sequence

SEQ ID NO: 1289 - protein, 367 aa, Arabidopsis thaliana; identical to SEQ ID NO: 110
  G896 Amino Acid Sequence

SEQ ID NO: 1290 - DNA, 1544 bp, Arabidopsis thaliana
  G896 Genomic Sequence
atgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccggtacagagtatttctatcttttcaaatgcctatgtttgctactatactactattccttggattttgaatacaattttccttggcctcttcaatctgataaacacacattccaagttaccatttcgaaccactttgataaaaatgtgttgcattccatagctgactaactaattgttcatcatggatggttttcattctcagaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacaggttattagtccctcaaccgcttctaaaagggatgttgcttacctctctcgttatatttaacatacatccatttttttttttaattgaaacagagctgggcagtatgtgtgggaggatcatcggcctaggtcaggtttgtggaaaggaactgctggtggagaagccatttcaattagtggatgtgatgatgatcagacttcggccgacacatcagtaagtagaacgactctaatcatacgtcttgctgttgtagttggttcctcctctcatgattaaaacacatacacaggcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggtaaaattctttcttgctctcttgtgttgatacagatcgataaatgttttcttaaatctgttttttgacaggagcctcaactgactgcttgccaaacattcgatgtctatgcaaagcctttcactctctag

SEQ ID NO: 1291 - DNA, 1544 bp, Arabidopsis thaliana; identical to SEQ ID NO: 1290
  G896 DNA sequence used for BLAST

SEQ ID NO: 1292 - DNA, 1120 bp, Arabidopsis thaliana
  G897 cDNA Sequence
aaacagtagagagagatatagagagcatcaatggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctgatattttccggtgaaagaaacatggtagtagtatatcggttaatagcagattaaggataattaaaactaaaatgtttcctgatttaatcaggggctaagttattgttagaagattgttgttttttgaattaattctcacaattgtatcctaaattatatagtttacttaatgttgaactaataaattttgatttacaatctcaaaa

SEQ ID NO: 1293 - protein, 294 aa, Arabidopsis thaliana
  G897 Amino Acid Sequence
MASSSRLCDSCKSTAATLFCRADAAFLCGDCDGKIHTANKLASRHERVWLCEVCEQAPAHVTCKADAAALCVTCDRDIHSANPLSRRHERVPITPFYDAVGPAKSASSSVNFVDEDGGDVTASWLLAKEGIEITNLFSDLDYPKIEVTSEENSSGNDGVVPVQNKLFLNEDYFNFDLSASKISQQGFNFINQTVSTRTIDVPLVPESGGVTAEMTNTETPAVQLSPAEREARVLRYREKRKNRKFEKTIRYASRKAYAEMRPRIKGRFAKRTDSRENDGGDVGVYGGFGVVPSF

SEQ ID NO: 1294 - DNA, 988 bp, Arabidopsis thaliana
  G897 Genomic Sequence
atggcgtcgtcgtcaagactttgcgattcgtgcaaatcgacggcagcaactctattctgccgcgcagacgccgcgtttctctgcggcgactgcgacggtaagatccacacagctaacaaactcgcatcacgtcacgaacgagtttggctatgtgaagtatgcgaacaagcaccagcacacgtcacgtgcaaagctgacgccgctgcgttatgcgtcacgtgcgaccgtgatatccactcagctaatccactctctcgccgccacgagcgcgtaccaatcactcctttctacgacgctgtaggtccagcaaaatccgcttcctcctccgtcaatttcgtagatgaagatggcggtgacgtcactgcttcgtggcttttagctaaagaaggaatcgaaatcactaatttgttctccgatcttgattatccgaagattgaggtaacgtcggaggagaatagctccggtaacgacggagttgttcctgtgcagaataagttgtttcttaacgaagattacttcaatttcgatctctctgcttccaaaatttctcaacaaggattcaatttcatcaaccaaactgtacgaatctctctctatcttcttaagcttccatggatctggaaaattttcagatctagatctgaaagtttggatctgatttgagtttgtgaaatgttgttaggtttcgacgagaacgatagatgtaccgttggtgcctgaaagtggaggagtgacggcggagatgacgaacacggagacgccagctgtgcagttatcaccggcggagagggaagcaagggttttgaggtatagagagaagaggaagaatcggaaatttgagaagacgattaggtatgcgtcgcgtaaagcttacgctgagatgaggccgagaatcaaaggacgttttgctaagagaacagattcgagagagaatgatggtggagacgtcggagtttatggcggattcggtgttgttccgagtttctga

SEQ ID NO: 1295 - DNA, 988 bp, Arabidopsis thaliana; identical to SEQ ID NO: 1294
  G897 DNA sequence used for BLAST

SEQ ID NO: 1296 - DNA, 1068 bp, Arabidopsis thaliana
  G899 cDNA Sequence
atgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcagttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctga

SEQ ID NO: 1297 - protein, 355 aa, Arabidopsis thaliana
  G899 Amino Acid Sequence
MGFGLESIKSISGGWGAAARSCDACKSVTAAVFCRVDSAFLCIACDTRIHSFTRHERVWVCEVCEQAPAAVTCKADAAALCVSCDADIHSANPLASRHERVPVETFFDSAETAVAKISASSTFGILGSSTTVDLTAVPVMADDLGLCPWLLPNDFNEPAKIEIGTENMKGSSDFMFSDFDRLIDFEFPNSFNHHQNNAGGDSLVPVQTKTEPLPLTNNDHCFDIDFCRSKLSAFTYPSQSVSHSVSTSSIEYGVVPDGNTNNSVNRSTITSSTTGGDHQASSMDREARVLRYREKRKNRKFEKTIRYASRKAYAESRPRIKGRFAKRTETENDDIFLSHVYASAAHAQYGVVPTF

SEQ ID NO: 1298 - DNA, 1157 bp, Arabidopsis thaliana
  G899 DNA sequence used for BLAST
atgggattcggcttagagagtatcaaatcaatctccggcggatggggcgcggcggcgcgttcctgtgacgcttgtaaatcagttaccgccgccgtgttctgtcgagttgactcagctttcttatgcatagcatgtgacacaagaatccattccttcactcgccacgagcgcgtgtgggtttgtgaagtttgtgaacaagctcccgccgccgtcacttgcaaagccgacgccgccgctctttgcgtcagttgtgatgccgatattcactctgctaatcctctcgctagccgtcacgaacgtgtccccgtcgaaactttcttcgactcagccgaaaccgccgtcgccaaaatctcagcttcttcgacttttggtatccttggctcatccaccaccgttgatttaaccgctgttccggttatggctgatgatctcggtttatgtccgtggttacttcctaatgatttcaacgaaccggctaaaatcgaaatcggaactgaaaacatgaaaggttcttctgactttatgttttctgatttcgatcggcttattgatttcgagtttccgaattcgttcaatcatcatcaaaacaacgccggaggagatagtcttgttccggttcagacgaaaacagagcctctcccgttaactaacaatgatcattgcttcgatattgatttctgcagatcaaagctctctgctttcacttacccttctcaatcagtcagccacagtgtaatttccctccgtcaaaatcaaatcttttatcataaaatttgcttaaattcagtaaaaaactaatctttgaattttgtgattttcaggtttcgacttcttctattgaatacggtgtagttcctgacggaaacacaaacaactctgttaaccggagcacgatcactagctcgacgactggtggtgatcatcaagcgagctctatggatagagaagctagggttttgaggtacagagagaagagaaagaacaggaaatttgagaagacgattcgttacgcttcgaggaaagcttatgcagagtcacggccaaggatcaaaggccggtttgcgaaaagaacagagacagaaaacgacgacattttccttagtcatgtttatgcttcagcagcacacgcacagtacggtgtcgtaccaacgttctga

SEQ ID NO: 1299 - DNA, 863 bp, Arabidopsis thaliana
  G902 cDNA Sequence
taattaatcagaggtttctacttattatttccacttctcatctctttcaatcgcaatctgagttctggctaaagattttgtcttgaaggtgagattcattgttccgaatagagtgagaaaaagacttataagattgaaaaagcaagatgcggattttgtgcgatgcttgcgagaacgcagccgcaatcatcttttgcgccgccgatgaagctgccctttgtcgcccctgcgatgaaaaagttcatatgtgcaacaagctagctagtcggcatgtacgtgttggtttagctgaaccaagcaatgccccatgctgtgatatatgcgaaaatgcacctgccttcttttactgtgagatagacggtagttctctttgtctgcaatgtgacatggtagtacatgttggtggcaagagaacacacggtcggtttcttttgctgagacagagaatcgagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgggattgatgtaaataacgagaacaatcacgagcctgcaggccttgtaccagttggaccctttaaacgagagtctgagaagtgataaggtgagagagagagagagaaagagactctttactctgattcaaaaaatcagtttaagaagaagattgtaaaaagtttcaagaactggagatttcatgtccgttttttttccttccttctgattcttagatcgttgctggtgtaaccgagctttgttgttgaa

SEQ ID NO: 1300 - protein, 183 aa, Arabidopsis thaliana
  G902 Amino Acid Sequence
MRILCDACENAAAIIFCAADEAALCRPCDEKVHMCNKLASRHVRVGLAEPSNAPCCDICENAPAFFYCEIDGSSLCLQCDMVVHVGGKRTHGRFLLLRQRIEFPGDKPKENNTRDNLQNQRVSTNGNGEANGKIDDEMIDLNANPQRVHEPSSNNNGIDVNNENNHEPAGLVPVGPFKRESEK

SEQ ID NO: 1301 - DNA, 1470 bp, Arabidopsis thaliana
  G902 Genomic Sequence
atgcggattttgtgcgatgcttgcgagaacgcagccgcaatcatcttttgcgccgccgatgaagctgccctttgtcgcccctgcgatgaaaaagtaacttctctcccaaaaaagcttcctttttttctttaactctcctctctatctattggttgtgctctgatgggttcgtcaaagatcaagtctttgttatctctgtctgggaattctcagttgatttggacctgagttgatctggcttttcgataactttgagctaaagaaataagatttttgagatttggtttctagattcttaggctcttcacatgagattagatatttcgaagtgtagtgaatccgtcaaaagagttcaaatagttgaaacctcttctctcatttggtggattaagatggttcagttgatgaatttacatgtttgattacatgagtgtttgttgctgcggtttcaatgattctactctgtcatgtacattgcagggaacgttttgtctccagagtttgcatttagtagtattaacttctggagaagaaaataatcgattttctgctctttgcgcttaatccttacttcagttagatgactcttaagggtaacactttatagtccttctcgagtcattggttcatccttctctactgcaatagctcttagtagttttcggattttgatcggaaatggattacttcaaagctttgtaatgttttcttctttcaggttcatatgtgcaacaagctagctagtcggcatgtacgtgttggtttagctgaaccaagcaatgccccatgctgtgatatatgcgaaaatgcacctggtatgatctctttacaatgaacttcccacactcgtgtttaatgttttcgcatatgtacatatattgaaaaatgaagagaaatcttttgtctgcaatgttttttgttgtgagaacagccttcttttactgtgagatagacggtagttctctttgtctgcaatgtgacatggtagtacatgttggtggcaagagaacacacggtcggtttcttttgctgagacagagaatcgaggtttgaattaactaattgtttctttctcacgcagacacacaatcattttgagtcgatttcttagttttaatagtcatcttgtgtttatcgtttcttgtagtttccaggggataagcctaaagaaaacaatacgagggacaatttgcagaaccaaagagtctctacaaatggaaatggtgaagccaatgggaagattgatgacgaaatgattgatctaaatgctaatccacaaagagtacatgagccatcatcaaataacaacgtatatgaatccctctatccaacatattctcaatctttgtttttgtattctcaattcgaatgtttctcaatgagcaggggattgatgtaaataacgagaacaatcacgagcctgcaggccttgtaccagttggaccctttaaacgagagtctgagaagtga

SEQ ID NO: 1302 - DNA, 1470 bp, Arabidopsis thaliana; identical to SEQ ID NO: 1301
  G902 DNA sequence used for BLAST

SEQ ID NO: 1303 - DNA, 1432 bp, Arabidopsis thaliana
  G908 cDNA Sequence
attctgagatagagaaagatgtcaggtttagcttgtaattcgtgtaacaaagacttcgaagacgacgctgagcagaagtttcactacaaatccgaatggcaccgttacaatctcaagcgcaagatagctggtgttcctggagtaacagaggcactatttgaagctagacaagctgctatagctcaagagaaggttaaagctgttgaagcaccgatgctttatagttgtggaatctgtaacaaaggttacaggagttccaaggctcatgagcagcatcttaagtcgaagagtcatgttttgaaggcttcgacgagtactggagaggaggataaagcgatcatcaagcagcttccgcctcgtcgtgttgagaagaataacactgctcaattgaagggttcgattgaggaggaagagagtgaagatgaatggattgaggttgattcggatgaggatttggatgcggaaatgaatgaggatggtgaagaagaagatatggatgaagatggtattgaatttgagttggatccggcttgttgtttgatgtgtgataagaagcataagactatagagaaatgtatggttcatatgcataagtttcatgggttcttcattcctgatattgagtacttgaaggatcctaaagggtttctgacctacctcggtctaaaggtcaagagagacttcgtgtgtctgtactgcaatgaattgtgccatccatttagtagtttggaagctgttcgtaagcatatggacgccaaaggtcattgcaaagtgcattatggtgatggtggtgatgaagaagatgcagaacttgaagagttctatgactacagcagcagctatgtcaatggagacgaaaatcagatggttgtgtccggtgagtcagtgaacactgtagagctttttggtgggtctgagcttgtgatcaccaagagaaccgataacaaagtaacgtctaggactcttgggtctcgagaattcatgcgctactacaaacagaagccagcaccgtcttctcagaagcatattgtcaactctctaacctccaggtacaagatgatgggtctagcaacagtgcagtcaaaggaggccatagtgaggatgaaggtgatgagagagatgaacaaaagaggagcgaaaagcagtgtcaggctcggaatgaagagcaacgtcatcaggaatctgcccaacaatgtcacctattagtcttgctcctcgattttcaggtctctcctctttgtttgattttgtgaccagagttttggtgagtaaatctatctaagtttttcactagtactcaagtatcttaggcccatttgggtctctgttttgtctgatttagtcttttgaaaatgttacgttttggctgagtttgtatctcttgcccagtgctttgtacactctacattaatctatatttcatttggtagaa

SEQ ID NO: 1304 - protein, 395 aa, Arabidopsis thaliana
  G908 Amino Acid Sequence
MSGLACNSCNKDFEDDAEQKFHYKSEWHRYNLKRKIAGVPGVTEALFEARQAAIAQEKVKAVEAPMLYSCGICNKGYRSSKAHEQHLKSKSHVLKASTSTGEEDKAIIKQLPPRRVEKNNTAQLKGSIEEEESEDEWIEVDSDEDLDAEMNEDGEEEDMDEDGIEFELDPACCLMCDKKHKTIEKCMVHMHKFHGFFIPDIEYLKDPKGFLTYLGLKVKRDFVCLYCNELCHPFSSLEAVRKHMDAKGHCKVHYGDGGDEEDAELEEFYDYSSSYVNGDENQMVVSGESVNTVELFGGSELVITKRTDNKVTSRTLGSREFMRYYKQKPAPSSQKHIVNSLTSRYKMMGLATVQSKEAIVRMKVMREMNKRGAKSSVRLGMKSNVIRNLPNNVTY

SEQ ID NO: 1305 - DNA, 1547 bp, Arabidopsis thaliana
  G908 Genomic Sequence
atgtcaggtttagcttgtaattcgtgtaacaaagacttcgaagacgacgctgagcagaagtttcactacaaatccgaatggcaccgttacaatctcaagcgcaaggttagaattcaatctcttgtgttttcgtttcgcgattaagttcgtctatggtttatggatttgattttggttcttctagttcatgattagtttggttttgaaatgtttatagatagctggtgttcctggagtaacagaggcactatttgaagctagacaagctgctatagctcaagagaaggttaaagctgttgaagcaccgatgctttatagttgtggaatctgtaacaaaggttacaggagttccaaggctcatgagcagcatcttaagtcgaagagtcatgttttgaaggcttcgacgagtactggagaggaggataaagcgatcatcaagcagcttccgcctcgtcgtgttgagaagaataacactgctcaattgaagggttcgattgaggaggaagagagtgaagatgaatggattgaggttgattcggatgaggatttggatgcggaaatgaatgaggatggtgaagaagaagatatggatgaagatggtattgaatttgagttggatccggcttgttgtttgatgtgtgataagaagcataagactatagagaaatgtatggttcatatgcataagtttcatgggttcttcattcctgatattgagtacttgaaggatcctaaagggtttctgacctacctcggtctaaaggtttgtgctttgtgcttagtctgtcttagatctttgtttttctttgctacttagtacttacatggttgttgtttcaggtcaagagagacttcgtgtgtctgtactgcaatgaattgtgccatccatttagtagtttggaagctgttcgtaagcatatggacgccaaaggtcattgcaaagtgcattatggtgatggtggtgatgaagaagatgcagaacttgaagagttctatgactacagcagcaggttccatttcttctgctttctcctctgttgttggtgtctaaatgtgcttgaactaattgtgtcttcttttgatgtgtgtttgtacagctatgtcaatggagacgaaaatcagatggttgtgtccggtgagtcagtgaacactgtagagctttttggtgggtctgagcttgtgatcaccaagagaaccgataacaaagtaacgtctaggactcttgggtctcgagaattcatgcgctactacaaacagaagccagcaccgtcttctcagaagcatattgtcaactctctaacctccaggtttgtctttaaccgatcagagatcatttatcactgtctctgtgtagaatttgaatctgacgtgaatgggtcttaaaacacaggtacaagatgatgggtctagcaacagtgcagtcaaaggaggccatagtgaggatgaaggtgatgagagagatgaacaaaagaggagcgaaaagcagtgtcaggctcggaatgaagagcaacgtcatcaggaatctgcccaacaatgtcacctattag

SEQ ID NO: 1306 - DNA, 1547 bp, Arabidopsis thaliana
  G908 DNA sequence used for BLAST
ctaataggtgacattgttgggcagattcctgatgacgttgctcttcattccgagcctgacactgcttttcgctcctcttttgttcatctctctcatcaccttcatcctcactatggcctcctttgactgcactgttgctagacccatcatcttgtacctgtgttttaagacccattcacgtcagattcaaattctacacagagacagtgataaatgatctctgatcggttaaagacaaacctggaggttagagagttgacaatatgcttctgagaagacggtgctggcttctgtttgtagtagcgcatgaattctcgagacccaagagtcctagacgttactttgttatcggttctcttggtgatcacaagctcagacccaccaaaaagctctacagtgttcactgactcaccggacacaaccatctgattttcgtctccattgacatagctgtacaaacacacatcaaaagaagacacaattagttcaagcacatttagacaccaacaacagaggagaaagcagaagaaatggaacctgctgctgtagtcatagaactcttcaagttctgcatcttcttcatcaccaccatcaccataatgcactttgcaatgacctttggcgtccatatgcttacgaacagcttccaaactactaaatggatggcacaattcattgcagtacagacacacgaagtctctcttgacctgaaacaacaaccatgtaagtactaagtagcaaagaaaaacaaagatctaagacagactaagcacaaagcacaaacctttagaccgaggtaggtcagaaaccctttaggatccttcaagtactcaatatcaggaatgaagaacccatgaaacttatgcatatgaaccatacatttctctatagtcttatgcttcttatcacacatcaaacaacaagccggatccaactcaaattcaataccatcttcatccatatcttcttcttcaccatcctcattcatttccgcatccaaatcctcatccgaatcaacctcaatccattcatcttcactctcttcctcctcaatcgaacccttcaattgagcagtgttattcttctcaacacgacgaggcggaagctgcttgatgatcgctttatcctcctctccagtactcgtcgaagccttcaaaacatgactcttcgacttaagatgctgctcatgagccttggaactcctgtaacctttgttacagattccacaactataaagcatcggtgcttcaacagctttaaccttctcttgagctatagcagcttgtctagcttcaaatagtgcctctgttactccaggaacaccagctatctataaacatttcaaaaccaaactaatcatgaactagaagaaccaaaatcaaatccataaaccatagacgaacttaatcgcgaaacgaaaacacaagagattgaattctaaccttgcgcttgagattgtaacggtgccattcggatttgtagtgaaacttctgctcagcgtcgtcttcgaagtctttgttacacgaattacaagctaaacctgacat

SEQ ID NO: 1307 - DNA, 760 bp, Arabidopsis thaliana
  G909 cDNA Sequence
aaaaaaaagataaaacaaaaaaaatgtctttcacaggaactctcgacaaatgcaatgtttgtgataagacagtctatgtggtggacatgttgtccattgaaggaatgccttaccacaagtcttgcttcaggtgtacccattgcaaaggaacccttcagatgagcaactattcctccatggatggagttttgtactgcaagactcattttgagcaactcttcaaggaatctggcaatttcagcaaaaactttcaaccaggaaaaactgagaagccagagctgactaggactcccagcaagatatcttccatcttctgtggaacacaagacaagtgtgccgcttgcgaaaaaactgtttaccctcttgaaaagatacaaatggaaggagaatgcttccacaagacatgtttccggtgcgctcacggtgggtgtacgctgactcactcctcctacgcctccttagatagcgttctctattgccgacatcactttaaccaactcttcatggagaaaggaaactacgctcacgtcctccaagccgccaatcaccgtcgcacagcctcaggcaacactcttccaccggaacctaccgaagacgtcgccgtggaggccaaggaagagaatggcgtttcagagtcttgaatatctcttacctgagtgtttttgagtgaatgattgaatgaatgttgttgcgggggaaagatttgatttcatttgtaatgagttgtttccatatgaagacatgaatttttttgttaaaa

SEQ ID NO: 1308 - protein, 205 aa, Arabidopsis thaliana
  G909 Amino Acid Sequence
MSFTGTLDKCNVCDKTVYVVDMLSIEGMPYHKSCFRCTHCKGTLQMSNYSSMDGVLYCKTHFEQLFKESGNFSKNFQPGKTEKPELTRTPSKISSIFCGTQDKCAACEKTVYPLEKIQMEGECFHKTCFRCAHGGCTLTHSSYASLDSVLYCRHHFNQLFMEKGNYAHVLQAANHRRTASGNTLPPEPTEDVAVEAKEENGVSES

SEQ ID NO: 1309 - DNA, 1164 bp, Arabidopsis thaliana
  G909 DNA sequence used for BLAST
atgtctttcacaggaactctcgacaaatgcaatgtttgtgataagacagtctatgtggtggacatgttgtccattgaaggaatgccttaccacaagtcttgcttcaggtgtacccattgcaaaggaacccttcaggtgcactcattactcattttcttgttagatcttctatgatcatattatatcaacaatttatctatgtgttgatggcagatgagcaactattcctccatggacggagttttgtactgcaagactcattttgagcaactcttcaaggaatctggcaatttcagcaaaaactttcaaccaggttcgtattataaaatctctgacatcgaatctctctatctttcaaatcatcatgatcataacaagtctctttcttttctcaggaaaaactgagaagccagagctggtaggttcatcattacatgtccttgtatatgattagcgtgtcaatatttcattttctttcttttatgatcgactaataggatctgtgtactgatttaaacattacagactaggactcccagcaagatatcttccatcttctgtggaacacaagacaagtgtgccgcttgcgaaaaaactgtttaccctcttgaaaaggttagtggtatacgcatctgcaaatgttctcatggcctaaaataccaacgaactagtctcgtagagaaatttatttgctctagaatttgttttttgttttttcatttccgtagaatttttctgttcggataaaatcattactagatcaaatggaaataaaattttgattttggtttggtttagtatacttttggttcgatttgagaacgtgatgttggttggtccaagcaaatgtggaatcaattttggcttggttctaatcgggttatttggtaacagatacaaatggaaggagaatgcttccacaagacatgtttccggtgcgctcacggtgggtgtacgctgactcactcctcctacgcctccttagatagcgttctctattgccgacatcactttaaccaactcttcatggagaaaggaaactacgctcacgtcctccaagccgccaatcaccgtcgcacagcctcaggcaacactcttccaccggaacctaccgaagacgtcgccgtggaggccaaggaagagaatggcgtttcagagtcttga

SEQ ID NO: 1310 - DNA, 480 bp, Arabidopsis thaliana; identical to SEQ ID NO: 31
  G911 cDNA Sequence

SEQ ID NO: 1311 - protein, 159 aa, Arabidopsis thaliana
  G911 Amino Acid Sequence
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 1312 - DNA, 673 bp, Arabidopsis thaliana
  G911 DNA sequence used for BLAST
ctcaatctagctctcttctctatctttctctaaatcatgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaattggtagttttaatctatgtcggcagaatgtttgttgtattaattccagtataactctatgtatattagcatagatcatctttttgtgatggaacaacactatatatctttatacaaaaaaaaaacactatatatattatcaaaaaaaaaaaaaaaa

SEQ ID NO: 1313 - DNA, 724 bp, Arabidopsis thaliana; identical to SEQ ID NO: 70
  G912 cDNA Sequence

SEQ ID NO: 1314 - protein, 224 aa, Arabidopsis thaliana
  G912 Amino Acid Sequence
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 1315 - DNA, 675 bp, Arabidopsis thaliana
  G912 Genomic Sequence
atgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaa

SEQ ID NO: 1316 - DNA, 675 bp, Arabidopsis thaliana
  G912 DNA sequence used for BLAST
ttactcgtcaaaactccagagtgacacgtcacccactccgtcaaagtcgttatgattccagccaacttccggcggcggcaaaagcatcccctccgccatattctcaaaaaagttgggcatccccaaaagcgcctcatcatccatataaaacacaccaccattctgctcctccgccctcctctccccctccctcaccccctcccctgccgcctcctctgcctccgccgcagttttagatccctccgtcgtagtctcattctgaaacgccattgcagcttcagacgcagctttctgaatctccttaggacaagtagtctcaggaatacgaagccgccaagcagaatcagcgaaattgagacaagcagagcgaccacgaagagctaaagcagcaacatcatgagcacgagcagccatttcaaccgtcggaaaagtacctaaccaaatcctagatttcttattaggctctctaacttcacaaacccatttaccagaattcctctgacgaactcctctgtaaatcggatgacgtgtctcacgaaacttcttcctcccagctcgtttctttggacaacttgaagctaactttggtgaacactcactactgtctgaaaccggagatctatgatcggagattgagagaaacgagtctgggaatgtagagtaaaatggattcat

SEQ ID NO: 1317 - DNA, 890 bp, Arabidopsis thaliana
  G913 cDNA Sequence
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 1318 - protein, 232 aa, Arabidopsis thaliana
  G913 Amino Acid Sequence
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 1319 - DNA, 699 bp, Arabidopsis thaliana
  G913 Genomic Sequence
atgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatga

SEQ ID NO: 1320 - DNA, 699 bp, Arabidopsis thaliana
  G913 DNA sequence used for BLAST
tcatttataactccaaagattatctccttcatgattctccggcgaatcatcttccatcgtcggatgtatcatcattctcggtggactcatcaacatcccttcagccatctccgtcaacaaagtcggcatattcaacatcgcttcctcatccataaactccaacgaacacgagttacacgacacttcttctaattcttcctctttgccgggttgaaccggttccaataccttctcatccccaccctgatccggttgcttcatctccgctgctctactagcagccgctcttatatccgcagcagagtttgaaaccggagccacgtaagtcaaagctaaaccaggaaaattcaaaacggcgtcgggtccttttaaagctaacgcagccacgtcgtaagcggcggcagccatctccggtaccggataagtcccgagccaaattcttgtcgttttacgtggctctctaatctccgatacccattttccgttacgtagtcgaatccccctgaaaatagagtgcttgccggataatccagtcgccgttcttctcgccggtgatccaccggaaggtctcggtgaaggagaagaagatgatcctggtgaggtttgaggagattgatcagtaggcaatgtgattgagacttcacgagacgtcgtcgtttcttgattcacggtggtcggagaattattattattcgacat

SEQ ID NO: 1321 - DNA, 1177 bp, Arabidopsis thaliana
  G914 cDNA Sequence
ctttttcttccctgttttagatagactcttagagtctctctagagtcaccggaacaatcacaaaagcgacgacatattactcattcctacaaatactcatgttggacctcaacctcggaatcttgtcgacacacaacgaagatgaagattgcaaagtaccaacttccatcttcattcaagaagaagattccattaatccctcaaacgacaacttgtctttgattacatttggaatccttaaacgaaacgtcgaaatccttcctcctccccctcctcctcctcctcctcctcctccttcggaaaatgaactctccggccccggaaatgagtggttggatctttcgtcgatgcaaagaaataaacaagaaacgttggtgatgaagaaaaaaagtcgacgtggcccaagatcaagaagctctcattatcgtggcgttaccttttaccgtcgaaccggccgttgggaatctcatatttgggactgtggaaaacaagtttatttgggtggtttcgacacagcctacacagccgcaagagcgtacgaccgagctgctatcagattccggggactccaagcagatatcaactttatcgtggatgattacaaacaagacattgaaaagatgaagaatttaagcaaagaagagtttgtgcaatctcttagacgagcgagtgcaagcttagcaagaggaggttctaaatacaaaaacacccatatgagaaatgatcacatccatctcttccaaaacaggggattgaatgcagcagcagcaaaatgcaatgagataagaaagatggaaggggatattaagttgggtgcccatagtaaaggaaatgagcacaacgatctcgagctaagtcttgggatatcttcatcgtcaaaagttagaattttggaaccagcagattattacatgggtttgaatcgatcggtgacgagtttgcatgggaagccgttgccgggatatctaccgatcacagaaattaaaccgttaaagacagttgtagcatcatcaggattccctttcattaccatgatcaatccttcttctttgtccttatcttgttttgatccatgaggtgatcactatttacttttaaaattttcccctttttattgataatctattgaatgacggaatgattatgtgacttatatctttttataaaccatattctt

SEQ ID NO: 1322 - protein, 325 aa, Arabidopsis thaliana
  G914 Amino Acid Sequence
MLDLNLGILSTHNEDEDCKVPTSIFIQEEDSINPSNDNLSLITFGILKRNVEILPPPPPPPPPPPPSENELSGPGNEWLDLSSMQRNKQETLVMKKKSRRGPRSRSSHYRGVTFYRRTGRWESHIWDCGKQVYLGGFDTAYTAARAYDRAAIRFRGLQADINFIVDDYKQDIEKMKNLSKEEFVQSLRRASASLARGGSKYKNTHMRNDHIHLFQNRGLNAAAAKCNEIRKMEGDIKLGAHSKGNEHNDLELSLGISSSSKVRILEPADYYMGLNRSVTSLHGKPLPGYLPITEIKPLKTVVASSGFPFITMINPSSLSLSCFDP

SEQ ID NO: 1323 - DNA, 1922 bp, Arabidopsis thaliana
  G914 Genomic Sequence
atgttggacctcaacctcggaatcttgtcgacacacaacgaagatgaagattgcaaagtaccaacttccatcttcattcaagaagaagattccattaatccctcaaacgacaacttgtctttgattacatttggaatccttaaacgaaacgtcgaaatccttcctcctccccctcctcctcctcctcctcctcctccttcggaaaatgaactctccggccccggaaatgagtggttggatctttcgtcgatgcaaagaaataaacaagaaacgttggtgatgaagaaaaaaagtcgacgtggcccaagatcaagaagctctcattatcgtggcgttaccttttaccgtcgaaccggccgttgggaatctcatatttggtattcattcataaactttaagttataaaatatattttaattagttttgagattaacacttggttttgggatttatgtgtagggactgtggaaaacaagtttatttgggtaattagatgagattttctatttctcttactattatattaaggtttaaaaccttcttggataagagaattctgaaaagagtaaaccaaatgatgaaagattttcactttttcagttttgtcttttgtttggttaaaaacaggtggtttcgacacagcctacacagccgcaaggtgtaagaaatagtaacagatgttacatgacataacattcgtcctttcaaaaattcttcattttttcttttttggacattttagtttatatctttagagaaatattagttgacttatatattcaaatacatatcagagcgtacgaccgagctgctatcagattccggggactccaagcagatatcaactttatcgtggatgattacaaacaagacattgaaaaggttttttttttcatataacttattgcttcctataaagagacagagaagttggacgttcgaatactataatatggatattttgaatgatgtggtagatgaagaatttaagcaaagaagagtttgtgcaatctcttagacgagcgagtgcaagcttagcaagaggaggttctaaatacaaaaacacccatatgagaaatgatcacatccatctcttccaaaacaggttcgattcgttactcttctcgcgggtacaatttcattcactattaaccgtgaccagttgattcctatcgcgtatatgattcacacatataatgcatacgatttgtaaaagtgtttgtatgaatactcataggggattgaatgcagcagcagcaaaatgcaatgagataagaaagatggaaggggatattaagttgggtgcccatagtaaaggtactttataaatgtagggtcacggctgtaaatatacatactaaatcattgttatcatttaggtgaaagctaaaaaccctaaccacaacttcactttgacacatgttgcacacctttgatttgatcaaccaaaccctagctagctagccttacctttcagaatcattctcgttcaaaattcaatgcatattagtttatagattttaatcaattttttttttttttttgaaagatttaaactttaatgcacaacgacaacagtaacacaaaccactaaactatatcttattcaacttgatcaatattttaatttaagacattacgacatgatttacgaaaagcttttaacgttttcaggaaatgagcacaacgatctcgagctaagtcttgggatatcttcatcgtcaaaagttagaattttggaaccagcagattattacatgggtttgaatcgatcggtgacgagtttgcatgggaagccgttgccgggatatctaccgatcacagaaattaaaccgttaaagacagttgtagcatcatcaggattccctttcattaccatgatcaatccttcttctttgtccttatcttgttttgatccatga

SEQ ID NO: 1324 - DNA, 1922 bp, Arabidopsis thaliana; identical to SEQ ID NO: 1323
  G914 DNA sequence used for BLAST

SEQ ID NO: 1325 - DNA, 1892 bp, Arabidopsis thaliana
  G915 cDNA Sequence
atcacttctctcattttcttcttctccaagcccccctcctttctatatatatctgaaattggtcttttataaaacaaacttccatttttcgtatggctgcttcttttcttacaatggacaatagcagaaccagacaaaacatgaatggttctgctaattggtcacaacaatccggaagaacatctacttcctctttggaagatcttgagataccaaagttcagatcttttgctccttcttcaatctctatctctccttctcttgtctctccttccacttgtttcagtccctctctttttctcgattcccctgcttttgtctcctcctctgctaacgttctagcttctccaaccacaggagctttaatcacaaacgtaactaaccagaaaggtataaatgaaggagacaagagcaacaacaacaactttaacttattcgatttctcattccacacacaatcatcaggagtttctgctccgaccacaactacaactacaactacaactacaacaacaacaaacagttctatctttcaatctcaggaacaacagaagaagaaccagtcagaacaatggagccaaaccgagactcgtccaaacaatcaagctgtatcttacaatggaagagagcaaaggaaaggagaggatggttacaattggagaaagtacggacaaaaacaggtgaaaggaagtgagaatcctcggagttactataagtgtactttccctaattgtccaacgaagaagaaagtggagagatctttggaaggtcagatcacagagattgtgtataaaggaagccacaaccatcctaaacctcagtctactagaagatcttcttcgtcttcttcgacttttcattcagctgtgtacaatgccagtttggatcataatcgtcaagcttcttctgatcagcctaattccaataatagctttcatcagtctgattcctttgggatgcaacaagaggataatactacttctgattctgttggtgacgatgagttcgaacaaggctcatcgattgtcagcagagacgaagaagattgtgggagtgaacctgaagcaaagagatggaaaggggacaatgaaacaaatggtgggaatggtggtggaagcaagacagtgagagagccgagaatcgtagtgcagacaacgagtgatattgacattcttgacgacggttacagatggagaaaatacggccagaaagtcgttaagggaaacccaaatccaagaagctactacaagtgcacaaccatcggttgtccagtgaggaaacatgtggagagagcatcacacgacatgagagcagtaatcacaacctacgaagggaaacacaaccacgatgttcctgcagctcgtggtagcggttacgccacaaacagagcaccacaggattcgtcttcagtcccgattagaccagctgctattgctggtcactccaactacactacttcttctcaagcaccatatacacttcagatgctgcacaacaacaacactaataccgggccttttggttacgccatgaacaacaataacaacaacagcaaccttcaaacgcaacaaaactttgttggtggtggattctctagagcaaaggaagaaccaaacgaggagacctcatttttcgattcgtttatgccctgaagaaaaaaggaaccagttgttccttttttatgttccttttgtacatttctgccaccaaaggattttactacttactagttatcctgcaggatagtaagtcagacttctatagtccatagagaaattttttcatttgttttttcacacgcctgtaatatgtttaatgtttgtactttgtaccatagaactagaacacggaataaaaccaatcaattttcagtttcaaaaaaaaaaaaaaaa

SEQ ID NO: 1326 - protein, 519 aa, Arabidopsis thaliana
  G915 Amino Acid Sequence
MAASFLTMDNSRTRQNMNGSANWSQQSGRTSTSSLEDLEIPKFRSFAPSSISISPSLVSPSTCFSPSLFLDSPAFVSSSANVLASPTTGALITNVTNQKGINEGDKSNNNNFNLFDFSFHTQSSGVSAPTTTTTTTTTTTTTNSSIFQSQEQQKKNQSEQWSQTETRPNNQAVSYNGREQRKGEDGYNWRKYGQKQVKGSENPRSYYKCTFPNCPTKKKVERSLEGQITEIVYKGSHNHPKPQSTRRSSSSSSTFHSAVYNASLDHNRQASSDQPNSNNSFHQSDSFGMQQEDNTTSDSVGDDEFEQGSSIVSRDEEDCGSEPEAKRWKGDNETNGGNGGGSKTVREPRIVVQTTSDIDILDDGYRWRKYGQKVVKGNPNPRSYYKCTTIGCPVRKHVERASHDMRAVITTYEGKHNHDVPAARGSGYATNRAPQDSSSVPIRPAAIAGHSNYTTSSQAPYTLQMLHNNNTNTGPFGYAMNNNNNNSNLQTQQNFVGGGFSRAKEEPNEETSFFDSFMP

SEQ ID NO: 1327 - DNA, 2064 bp, Arabidopsis thaliana
  G915 Genomic Sequence
atggctgcttcttttcttacaatggacaatagcagaaccagacaaaacatgaatggttctgctaattggtcacaacaatccggaagaacatctacttcctctttggaagatcttgagataccaaagttcagatcttttgctccttcttcaatctctatctctccttctcttgtctctccttccacttgtttcagtccctctctttttctcgattcccctgcttttgtctcctcctctgctaacgtaagcctctctgttttttttctctgtttcttttgaaatgaatccaattagtgatgataatctgtgtttgatgtatcattgatttaacatcttgacaatgaatcgtgatcggaagtgataaagttatgggtcaacggtttcaaagagagagaaagacttttagagtcaactctcgactctttcttaattatgttattgctatttgtctcttttcttgaagtctgaacaattcttgggattgttttgcaggttctagcttctccaaccacaggagctttaatcacaaacgtaactaaccagaaaggtataaatgaaggagacaagagcaacaacaacaactttaacttattcgatttctcattccacacacaatcatcaggagtttctgctccgaccacaactacaactacaactacaactacaacaacaacaaacagttctatctttcaatctcaggtatgtacttcatcaacagctcaaatcctctgtttatgagtttttctataactttgttttgagtttcaggaacaacagaagaagaaccagtcagaacaatggagccaaaccgagactcgtccaaacaatcaagctgtatcttacaatggaagagagcaaaggaaaggagaggatggttacaattggagaaagtacggacaaaaacaggtgaaaggaagtgagaatcctcggagttactataagtgtactttccctaattgtccaacgaagaagaaagtggagagatctttggaaggtcagatcacagagattgtgtataaaggaagccacaaccatcctaaacctcagtctactagaagatcttcttcgtcttcttcgacttttcattcagctgtgtacaatgccagtttggatcataatcgtcaagcttcttctgatcagcctaattccaataatagctttcatcagtctgattcctttgggatgcaacaagaggataatactacttctgattctgttggtgacgatgagttcgaacaaggctcatcgattgtcagcagagacgaagaagattgtgggagtgaacctgaagcaaagagatggtacagatcatcatcaccctccaaatttgctactctttgaacaatcttgaatatgaaagttctaaaatgtatgtttttttgtgttttcaggaaaggggacaatgaaacaaatggtgggaatggtggtggaagcaagacagtgagagagccgagaatcgtagtgcagacaacgagtgatattgacattcttgacgacggttacagatggagaaaatacggccagaaagtcgttaagggaaacccaaatccaaggtaataacataaacaattgtgcatctcaataactcagaattaaggttcttgagaatctgaccttttgttttcttttcatttgctgaatcttaacagaagctactacaagtgcacaaccatcggttgtccagtgaggaaacatgtggagagagcatcacacgacatgagagcagtaatcacaacctacgaagggaaacacaaccacgatgttcctgcagctcgtggtagcggttacgccacaaacagagcaccacaggattcgtcttcagtcccgattagaccagctgctattgctggtcactccaactacactacttcttctcaagcaccatatacacttcagatgctgcacaacaacaacactaataccgggccttttggttacgccatgaacaacaataacaacaacagcaaccttcaaacgcaacaaaactttgttggtggtggattctctagagcaaaggaagaaccaaacgaggagacctcatttttcgattcgtttatgccctga

SEQ ID NO: 1328 - DNA, 2064 bp, Arabidopsis thaliana
  G915 DNA sequence used for BLAST
tcagggcataaacgaatcgaaaaatgaggtctcctcgtttggttcttcctttgctctagagaatccaccaccaacaaagttttgttgcgtttgaaggttgctgttgttgttattgttgttcatggcgtaaccaaaaggcccggtattagtgttgttgttgtgcagcatctgaagtgtatatggtgcttgagaagaagtagtgtagttggagtgaccagcaatagcagctggtctaatcgggactgaagacgaatcctgtggtgctctgtttgtggcgtaaccgctaccacgagctgcaggaacatcgtggttgtgtttcccttcgtaggttgtgattactgctctcatgtcgtgtgatgctctctccacatgtttcctcactggacaaccgatggttgtgcacttgtagtagcttctgttaagattcagcaaatgaaaagaaaacaaaaggtcagattctcaagaaccttaattctgagttattgagatgcacaattgtttatgttattaccttggatttgggtttcccttaacgactttctggccgtattttctccatctgtaaccgtcgtcaagaatgtcaatatcactcgttgtctgcactacgattctcggctctctcactgtcttgcttccaccaccattcccaccatttgtttcattgtcccctttcctgaaaacacaaaaaaacatacattttagaactttcatattcaagattgttcaaagagtagcaaatttggagggtgatgatgatctgtaccatctctttgcttcaggttcactcccacaatcttcttcgtctctgctgacaatcgatgagccttgttcgaactcatcgtcaccaacagaatcagaagtagtattatcctcttgttgcatcccaaaggaatcagactgatgaaagctattattggaattaggctgatcagaagaagcttgacgattatgatccaaactggcattgtacacagctgaatgaaaagtcgaagaagacgaagaagatcttctagtagactgaggtttaggatggttgtggcttcctttatacacaatctctgtgatctgaccttccaaagatctctccactttcttcttcgttggacaattagggaaagtacacttatagtaactccgaggattctcacttcctttcacctgtttttgtccgtactttctccaattgtaaccatcctctcctttcctttgctctcttccattgtaagatacagcttgattgtttggacgagtctcggtttggctccattgttctgactggttcttcttctgttgttcctgaaactcaaaacaaagttatagaaaaactcataaacagaggatttgagctgttgatgaagtacatacctgagattgaaagatagaactgtttgttgttgttgtagttgtagttgtagttgtagttgtggtcggagcagaaactcctgatgattgtgtgtggaatgagaaatcgaataagttaaagttgttgttgttgctcttgtctccttcatttatacctttctggttagttacgtttgtgattaaagctcctgtggttggagaagctagaacctgcaaaacaatcccaagaattgttcagacttcaagaaaagagacaaatagcaataacataattaagaaagagtcgagagttgactctaaaagtctttctctctctttgaaaccgttgacccataactttatcacttccgatcacgattcattgtcaagatgttaaatcaatgatacatcaaacacagattatcatcactaattggattcatttcaaaagaaacagagaaaaaaaacagagaggcttacgttagcagaggaggagacaaaagcaggggaatcgagaaaaagagagggactgaaacaagtggaaggagagacaagagaaggagagatagagattgaagaaggagcaaaagatctgaactttggtatctcaagatcttccaaagaggaagtagatgttcttccggattgttgtgaccaattagcagaaccattcatgttttgtctggttctgctattgtccattgtaagaaaagaagcagccat

SEQ ID NO: 1329 - DNA, 1130 bp, Arabidopsis thaliana
  misc_feature (1100)..(1100): n is a, c, g, or t
  G921 cDNA Sequence
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatttgaatttgtcatgagtaagagaaagagagtagattataatccnttgtgatactgaaaaaaaaaaaaaaaaaaa

SEQ ID NO: 1330 - protein, 302 aa, Arabidopsis thaliana
  G921 Amino Acid Sequence
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 1331 - DNA, 1523 bp, Arabidopsis thaliana
  G921 Genomic Sequence
atggatcagtactcatcctctttggtcgatacttcattagatctcactattggcgttactcgtatgcgagttgaagaagatccaccggtacgcttctctcagattcttcattctccacatgttcagaaattttcaattatcatggagctttttaatctagtatctcatcattatgtattatacacttacatttttcaattcggttggttttgaaaatatataaactaactcaactatccatagacatttttttcagatgtataatctataaacatagatattttcttatacttcacaaatatttttatatataattggcataaactttaacaacaagaaaaattcgttagtaattcatgtggtgggttcttgaaatatagatgtaacgctagatcataaaatcatattaaacttatagtatgaagaaaataatatggttactaacttcatgcaatatatatatatatatatatatatatataaatgataaattgcagacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgtaagcattcatgaaaatgatcaaacttggtatctatctatctttagaaactttattttatatggtttactgattgtagaagttgtttcttataggttgtgaaagatgggtatcaatggaggaaatatggacagaaagtgactagagacaatccatctccaagagcttacttcaaatgtgcttgtgctccaagctgttctgtcaaaaagaaggtaattgataaagaaaaaaaactgactctcgcttaaaatatgaattggcataatacaaatttgatagacttattaatctgattttgatcctgtgtttgtttctattcaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatag

SEQ ID NO: 1332 - DNA, 1523 bp, Arabidopsis thaliana; identical to SEQ ID NO: 1331
  G921 DNA sequence used for BLAST

SEQ ID NO: 1333 - DNA, 1385 bp, Arabidopsis thaliana
  G927 cDNA Sequence
ggaatctgaagctcttctctactctctactctatcactccatctgtgaacatatctttcttattcttctaggcactatctatttttcactttttgtaattggaatttggagatggctatgcaaactgtgagagaaggtctcttctctgctccacagacttcttggtggactgcttttggatctcagccgttggctccggagagtctcgccggcgattctgactcattcgccggagttaaggtcggatctgtcggagagacaagacaacgtgtggataaacagagcaactctgcaacgcacttagctttctcacttggtgatgtaaagagtccaagacttgtgccaaagcctcatggagctactttctcaatgcaatcaccttgcttggaacttggattttctcagccaccgatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaacctgatcctttaccgtttcacagtcaaacggagagagataaagaactcttgccttggtataaaggattttcctttttgccaatccgctttggctgtgaacaggcaaatcatctttggctcattctctattaaggtaacttcgccgtgaggtgaaaaaagctttgatatatttatcttcagtgtaaaagtagttaaaactggtgaagaacaatgatgtgtttggtcactaaacccacttgttccaactagtagtgtgtgttttaagaaaactctgttatctgattttgtagctctctctggctttgtgtgtttctcaaacaactgtaacaacttttaagttatgtggtttatgtaacatatttaagacctgtgtttttgtataaaaaaaaaa

SEQ ID NO: 1334 - protein, 295 aa, Arabidopsis thaliana
  G927 Amino Acid Sequence
MAMQTVREGLFSAPQTSWWTAFGSQPLAPESLAGDSDSFAGVKVGSVGETRQRVDKQSNSATHLAFSLGDVKSPRLVPKPHGATFSMQSPCLELGFSQPPIYTKYPYGEQQYYGVVSAYGSQSRVMLPLNMETEDSTIYVNSKQYHGIIRRRQSRAKAAAVLDQKKLSSRCRKPYMHHSRHLHALRRPRGSGGRFLNTKSQNLENSGTNAKKGDGSMQIQSQPKPQQSNSQNSEVVHPENGTMNLSNGLNVSGSEVTSMNYFLSSPVHSLGGMVMPSKWIAAAAAMDNGCCNFKT

SEQ ID NO: 1335 - DNA, 1403 bp, Arabidopsis thaliana
  G927 Genomic Sequence
tcaggttttgaaattgcagcagccattatccattgctgctgctgctgctatccacttgctaggcattaccatgccaccaagagaatgaacgggagaacttaggaagtagttcatgctagtaacttctgatcccgacacatttaatccgttcgataagttcatggtcccgttttccggatgaacaacttcagaattctgagagttactttgctgaggcttaggctgagactgaatctgcatacttccatcacctttctttgcattggttccgctattttccaagttctgacttttagtgttcaagaatctcccaccggatcctctaggacgccgcaatgcatggagatggcgcgaatgatgcatatatggctgcaacatacataacaaaagcaaacacactaattcagtaataaaatctcatttgcacaaaagtatcaaactagtttctatatgttaccttgcggcatctactactcaatttcttctgatcaagaacagcagcagcctttgcgcgggattggcgtctccttatgattccatggtattgctttgagttcacatagatggtactatcttccgtttccatgtttagaggaagcattaccctgctctgagatccataggctgaaacaactccatagtattgttgttctccatagggatactttgtatagatctaaatgaccaaagtaaacagccaacaaacactaaatactcagaaacaaattaaaggaaactcatgataggcttattcattatatgtttttcaatgcggaaaagtttttaccggtggctgagaaaatccaagttccaagcaaggtgattgcattgagaaagtagctccatgaggctttggcacaagtcttggactctttacatcacctaatacatacatagtgaaaattattccaaatcagatcacaaacgcattcttagattcacaattacctacagaacaaataacatttttacaatccagaatttgaaccataaagatatctttttaaacatctttatatcttgtagaatcttagattctcttttcggacaatttagctcagttctgttcactctcagtcatacctataaataactagtaaaacatgtactagcactttccaaaaaaagccacttttgacaaattcagaaattttcactagaaccatctatttgagggcaaaagaagttaagagtttaccaagtgagaaagctaagtgcgttgcagagttgctctgtttatccacacgttgtcctgtctctccgacagatccgaccttaactccggcgaatgagtcagaatcgccggcgagactctccggagccaacggctgagatccaaaagcagtccaccaagaagtctgtggagcagagaagagaccttctctcacagtttgcatagccat

SEQ ID NO: 1336 - DNA, 1403 bp, Arabidopsis thaliana; identical to SEQ ID NO: 1335
  G927 DNA sequence used for BLAST

SEQ ID NO: 1337 - DNA, 1516 bp, Arabidopsis thaliana
  G928 cDNA Sequence
ctcatggcgatgttggtttcccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactgattccgttgctaatcgtcgcggtcctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatctgagacagtggatcttggtgctgtgttcatgttcccaccaagaaggggaagtcatccttggctactactagttctttcgcttgttgtaacttcagtgtttttatttcatattatgtctgtgttagacatcacaagaacgaccaagatcttcactttgaaacactctattaccttttcatcttctgttaccatggatctcttgtctaaactagtgatatgattcttctgataaaaaaaaaaa

SEQ ID NO: 1338 - protein, 340 aa, Arabidopsis thaliana
  G928 Amino Acid Sequence
MMHQMLNKKDSATHSTLPYLNTSISWGVVPTDSVANRRGPAESLSLKVDSRPGHIQTTKQISFQDQDSSSTQSTGQSYTEVASSGDDNPSRQISFSAKSGSEITQRKGFASNPKQGSMTGFPNIHFAPAQANFSFHYADPHYGGLLAATYLPQAPTCNPQMVSMIPGRVPLPAELTETDPVFVNAKQYHAIMRRRQQRAKLEAQNKLIRARKPYLHESRHVHALKRPRGSGGRFLNTKKLLQESEQAAAREQEQDKLGQQVNRKTNMSRFEAHMLQNNKDRSSTTSGSDITSVSDGADIFGHTEFQFSGFPTPINRAMLVHGQSNDMHGGGDMHHFSVHI

SEQ ID NO: 1339 - DNA, 1390 bp, Arabidopsis thaliana
  G928 Genomic Sequence
tcagatatggacagagaaatggtgcatgtctccacctccatgcatgtcattagactgaccatgaacaagcatggctcggtttatcggagttgggaaacctgaaaactggaattcagtgtgtccaaagatatcagcaccgtcggaaacagaggtgatgtctgagccagaagtggttgagctgcggtctttgttgttctgcagcatatgagcttcgaatctagacatgttggtctttctgtttacctgttggcctaacttgtcctgttcttgttctctagcagcagcctgttcggattcttgaagaagttttttggtgtttaggaatcttccaccagatcctcttggccttttaagagcatgaacatgtcgagactcatgaagatagggctgttgcaataagaaaaagaaaagatgagcaaagcaattctacgtgtatgcgtttgtttaaaatataaaccaaaatttggtaactaccttacgggctctgattagtttgttttgagcctcaagcttagcacgttgctgtctcctcctcataattgcgtggtattgcttcgcattgacaaagactggatcagtttctgtgagctctgctggtaaaggaacacgaccaggaatcatactcaccatttgaggattgcatgtctgcaaaagagattaagagacttgagatctgatggacagataaaactgaaaggtaaatctcccacttggaaacgaagggtgtacttactggtgcctgtggtaggtaagttgcagctaataaaccaccataatgtggatcagcatagtgaaatgagaaattagcctgaaccatgtataaacataagatatcagtctacaatcaaaagctttgctatgattactgtattcatagagttacaaatacctgtgcaggagcaaagtgaatattcggaaatccagtcatcgagccttgtttaggattacttgcaaaccccttccgttgagttatttcagatcctagagaaacaactgagaaagtaagaaagaggataacattctttatggcaaaaggatgattcttttgtcaatgacacaagaagtaaaacatatatataccaacaatctaacctgatttagccgaaaaggagatttgtctggaaggattatcatcaccactactagcaacttcagtataagattgaccagtggactgtgttgaagatgaatcttggtcctgaaaactgatttgctttgtagtttgtatatgcccaggtcttgaatcaaccttcaagcttagtgattcagcagaaccgcgacgattagcaacggaatcagttggaaccactccccaagagatgctagtattaaggtatggcaaagtggaatgagtagctgaatctttcttattcaacatctgatgcatcat

SEQ ID NO: 1340 - DNA, 1390 bp, Arabidopsis thaliana; identical to SEQ ID NO: 1339
  G928 DNA sequence used for BLAST

SEQ ID NO: 1341 - DNA, 953 bp, Arabidopsis thaliana
  G929 cDNA Sequence
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagtaaaaaaaaa

SEQ ID NO: 1342 - protein, 198 aa, Arabidopsis thaliana
  G929 Amino Acid Sequence
MTSSVHELSDNNESHAKKERPDSQTRPQVPSGRSSESIDTNSVYSEPMAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 1343 - DNA, 1134 bp, Arabidopsis thaliana
  G929 Genomic Sequence
atgttttgctggtcagataacaatgaaagtcatgcgaagaaagaacgtccagattcccaaacccgaccacaggttccttcaggacgaagttcggaatctattgatacaaactctgtctactcagagcccatggtaatttctctcagccaaaatctcaactatttgtgcaggctacattcaatgagtgatctttatttcgattatatgatatttggtttagtttctgtgtgatcttgctctcggttataatatgtttgcttgtgattctctttttcaatgctaaaagttttgttttgatgcttacaatgccaaaacttggttgtttgagataattcaagcaagaaagtcccgggatcatcgcctttctgcagttttagacttcgtacgaatgtaaactttgattgctttgaaaatcagtcttgagatgcagtgtaatgataatgttgattccaagtaatgctaaactttttaacctgagatgatacggtttttgtttttgtgtgtgttggtattgaaggcacatggattatacccgtatccagatccttactacagaagcgtctttgcacagcaagcgtatcttccacatccctatcctggggtatgtattatttattactcagccccaacgtctccggtttggaatatttagaaaagcttttgttttatttttaaagtttttttttcaggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaaggtaaaatcctggcgggcaagtgctgtaatttgtttggtagaatccttcccaataagttgtaatttcttgttttcagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttga

SEQ ID NO: 1344 - DNA, 1134 bp, Arabidopsis thaliana; identical to SEQ ID NO: 1343
  G929 DNA sequence used for BLAST

SEQ ID NO: 1345 - DNA, 1519 bp, Arabidopsis thaliana
  G932 cDNA Sequence
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 1346 - protein, 335 aa, Arabidopsis thaliana
  G932 Amino Acid Sequence
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 1347 - DNA, 1409 bp, Arabidopsis thaliana
  G932 Genomic Sequence
ctagaacaacacttcctgaccctctagtgacatgttattgatgatcatatcgtggctttgctcatcaaagagccatttctcgaacaaagaaagagagccttgtgtaattagaccattaatgtcatggtctattagtttaggcttctcttcagcttcatctatggagttgaagctgaacaaagaatggtcaatcccttctccgtctccttcggttgtgctagggctcgaagctgccgtggtgatagccatctcggtggctgcaaccggcaagggcaccgaggtctttggtgtgtctttcataaaattctgaagcaaacgagcaatgttctcagcacttgaagcatagaccccagatgggtatggattagtgtttctcgtggtggtggtggtggtggtggtagaggacgaagaagatgatggaccataaccaagatcgggaatagaaaaattagttgggttttgtggtttgtcaatagacaaggcatcacaaagagcttgtttagccatgttgatatctgtctgaagccttctctcccattgacctttactggagttgctgctttgatgtgaggtagtgtttttgtttgatatggagaagtctttattatcaaggccattgttgatagtactatcacaagaatcattcatcttcttgagctttttcttcaaatgagtgttccaatagttctttatatcattgtctgtcctttctggaagatatgatgctatagctgcccaccttcataattatttggtccccaagttatttaaagttcaaaaccttatctttatgcatacccaaaaaaataaaagaatttgtatacttttatagatcatgtgcatgtgaatatgtatgtatttacctgtttcccaaaagagcttgaagatggagaatcatcttctcttcatgctcggtgaaatttccacgcttgatcccaggtcgaagataattagtccacctcaatctacagcttttgctacatctcctcaaacctaaatcaccacaacaacaacaagataatttcattaaaagagtaattaatttgtgatatatggacaaaaaagctggtgccataaatcggatattattacaatttttccttttcattaaatgatcataccaaccaagtggaagccagaacaaaacaatcacaaacccaagaaaaaaacaaaaaacattaaagggtacttctgaagagtataggggttaacaattgaaattaaaatattactattgttcattaaaaaaacataatattaagatagaagaagatacctgtgtgagtaggcacagatctccagtttccaggaccatgttcttggatgtaagaaaccaagatgatatcttcctctggtgtccatggtcctttcttcactccaatcttgtcacagcatggtggtcttcccat

SEQ ID NO: 1348 - DNA, 1409 bp, Arabidopsis thaliana; identical to SEQ ID NO: 1347
  G932 DNA sequence used for BLAST

SEQ ID NO: 1349 - DNA, 1755 bp, Arabidopsis thaliana; identical to SEQ ID NO: 42
  G938 cDNA Sequence

SEQ ID NO: 1350 - protein, 584 aa, Arabidopsis thaliana
  G938 Amino Acid Sequence
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 1351 - DNA, 1755 bp, Arabidopsis thaliana; identical to SEQ ID NO: 42
  G938 Genomic Sequence

SEQ ID NO: 1352 - DNA, 1755 bp, Arabidopsis thaliana; identical to SEQ ID NO: 42
  G938 DNA sequence used for BLAST

SEQ ID NO: 1353 - DNA, 1722 bp, Arabidopsis thaliana
  G939 cDNA Sequence
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatgttttctagtctttatagctttgtctcttgcttattctctcattaaacacagtttttgatctctccatttcatagcccatgtagcaatggagaagattaggtttcataataagttaataaccaaattcaaa

SEQ ID NO: 1354 - protein, 518 aa, Arabidopsis thaliana
  G939 Amino Acid Sequence
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 1355 - DNA, 11722 bp, Arabidopsis thaliana
  G939 Genomic Sequence
tttgaatttggttattaacttattatgaaacctaatcttctccattgctacatgggctatgaaatggagagatcaaaaactgtgtttaatgagagaataagcaagagacaaagctataaagactagaaaacataaaaagaaaactctgaagctttctttactgaatccaagatgtgggcaactcttgcccttgattatgcagattgttctctgttcctactgtttcctcacctccattgaagtcagtaggtaagactaaaccaagattctgattcagcgtcgaaggagaaggattcaaatcctcaaccaagtcatcgttgcctctttgtggagcttttggtctgtagagatcgttgggatgattaaactggtcttgaaagctctgaacctgctgctgcatcccgttataatccggacaaggaaccattaaacccgtcataccatagggtttagttggttggtagaaggaagtgactttataaggacaagtcatttggtgattctctcttaagttcctgtcaagaaatcccatatgtggttggctataaggacagagactgttctcacatgttaggagtgttggatgcattggcatcccaaaatcttcttcaaactttctcttgtaaacacagttgtagttgttttcaaattcaggatactgctgattggtccgatgagtgccaccaatcagttcaacatcatagtctgtagattcaggaaacaaaacatctgggtctccaccggttgcaggaacaagaaagttagaagtgttgttgttttctctagacatggctatttgatcaacaatagccttttctcggtaaagagcagcgagccataaagcgccttctcttgacgtcattttctcctgcaaacttctagaccgtctcacgagattgggtatgttgctaatgtcagaagccatatgtctgattacaccaatcaaaacaccaattttccacagcttcttgagatcatgaggcttcttgtaaggtggcggaacacctcgaaaatcaacgggtaaagacagttgatcccaccaatcttctttccccgttggccaccatggcggtgtcacgcctttctccaacggaaaccgcctctgaggagggttgcagtgaggaaacagagccgataacagagctccaagagtagtatcttgaagctcaagcaacttctgtgcggtagaatccccaacctcagaccctgaatcacttccatcagaaagattgatatccctttggtgcttgattatagcagctgggccgttcctatcaaacctcactttgtctttccaccattcacggagattatcagaagatcccgctaccgttttcccattctctaacacaatcccataaacaaaaccttgagctttatatcgctccattgtcttcgacatgtacttcaagatcccatcttgtgccttgtacatggttctcttactagagtgctctggaaaatcatcatgttgctgcttcaacaacaatcttgttcctagaccgttcttcgccatttccttgagccgctttaaacgctgcttgtctctccagatcttcttctcaagctcctctatttccatttcctcatcactactcagatcatcgcacaaagccgtatgcgaatcagaacacatatgtccctctgtaaatggaggcgccgagctacaaactaaactccggaacatccctatattgttgttatacatatccatagaatctgcaaataatgtcatcaactatgattcactttaagaataaaattgcataatcatcgtcatttagtaatgccgtatttatcaaaatctaaattaaaactctctagcaataacataacacaaaagaaaaaaacagagacttttagtgaaagatcgagagatctaacttgtgaaataagattcatcatatgaataacacaaagatttagagatccaaattccattagttattactcccaagggattgaataaatactataggaaaactactaccaaagagattaagtacataatataggagaaatatttagagaaggtaaaagaaaatcacaaacaagattaatggtttatcatcaaatgattatacagtaaaagcatcgatctttttctttcttttgattcttatcaaagcatataacgacaaaacaatccagtccgtattactactgaaatacttgatcttgcaaaagtgaaaatggaacccatcggacaaaatatcagatagaccaaacccaacaagtcaaaaaacaatatttgcaagcagacaatatacgtaaaagcaaaacaaaacaaaaacaaaaataaagagaaatcgaaggaagaagagaatatacccagaaaactcttgagacctttgtgttgcttcggccaccaaattcaaaccaaagaagctattgggaccttcagagagagagaagagatagagacatgtatgtatgtatgtttgtgtatctatatatattatgagcattaaataagaagagactgcgaaagggtggtgataataggcctgtaaaaaccatgctaaacgacacatttctttgtgtaaggatatggtaaaaatttcttatttatctcctttgagtttcattccatttctagttcagattctttatttaaatatatagtcacttcttttaaaaaaaagaaaaattaacatgcccataaaatggttatttctgcctaaattattttttgtttgatagcctaaaattattaatatcaatataaaaaatataatcatgtctactataagaaaaatatcaaatgtagatgtatgcttaagcgggaaaaatataacccctaaacataaagcgagtatttttgaaaacaaataggaatcaagtaccaaatatagacattttctaaggcacgtaaatttactattttaatggtataaaatcgtagcatgtaattttttttttataaaatatttaaataatagctttaaattaattggtgcgtatgtttgaattttaaaatttgttaatgcatttaatttcatggggagctgtatctaaatatatcggtctagataaacaaatagtaaaacagtaagtagttccgtacgatctatttatactttaaaaaaaacaaaatacaacctatttatactaatttacttgtattagttttatcaattagtttttacaatggaatttaaatgagattcttgtagttctaccaagtcctgaatactaaaaacttatcatgcccaaagacttacaaaataattactctctttgtatcaaaataaaaacgtttaaatttttccatattaagaaattaatgattttctttattttactaaatcaaaagatattttatgatttatctaatcacagtccaaccaataaaaataaagtaaaaaatgcacattgtcataaaatatatagaaattattacattttgctttgaaaatgtaaacaaatcacataatatgatatagaaaaaaatatcatagttttaaatacaaaagctggcagagtatgaaagaaaagggaaaaaatgttgccagtactcactaattaattctgatacatatatgataatgctaaaaaaacaaaattattgaagaattccttaaaatagctcagaattgtggcgctttcaatttcttacaaaataccaaatttccatgatttttgtttaaacatttaaaagcatacaatttgacattctttagaatagaataaaaatacttagtttaccatttttgtttttgcattatattagtatatgctagatataagagccttttaaattgcacaagctcatagcattaaaattgaaaagtttcatataggtaagtattttgtattaagaattgtgaattttgtattctctatgaatttatgatatcttatatatactaatatacattcaatccctttggatactggctctaaatatttgaccaacagattggtttctagtattactgtctatatatatttccccattttcctttaagcattccataaatgtatttttaatataaaattagtagttaacaatgttttttattttaataattttctatttatccagaccatctcaagaagccaaaatttaaagatgataatatggtgttttaaaatctatttaaaacaatcctttgtagcttattgtattgttttctatgctgaattgtaaactgtgtcatataattgaagatattattttttctttagacaaacaaatatataaccttctaaatcacattgtctatatatccaatggacgattatgattcttatgtaaatcgatcaacatttttcacagtgatatttgtaatgcacgactcaaaaaataaaataaaactctcatcaaatattcgtttttcgattttaaaactctcccattaaaagataggtatttgagatttcgtaatcttggcgccatactataaattgtcgggtttctcattgcaaaatgttatataaactacttaataaatcatgaaatgttgacctttaattatgatgatatattatctataactgtttgtataacggtcaacgtgtgggtaatgaaacaggtaatactttcgttttattttattttggttatcctttagaaatgtcaactagttatctaaatatcatatttgattttaagttcaaatgagatacggtatatagtacaactatatattatagggtataaaacctatttcaaatcaaagaaaaacaataccagcatgatgtttttagtatttatttcttaatatgataatataatgttttcttagagaaaatgtagaagaggtgcaatgaatataaccaaatagccaataggaaagtaaacaagtgccacgaaggcacgtttcgtcgccagcaatgattctttaaaatgtctgaaacgtgtctcccgggatttttttgtcggctactccacaattattggaactctcgtcgttttcctataagtaatgttttattaatatagtatgtgaaaatatgcaactatctatcgtacacattaaccaattaacgaccactcgtaaactgtttttaacgtccttgctttggcctatatgccttatagtgcccatgtctctcgaatggtcggtcgccaaaattattcaaactcaaatcgtgttgaaaattcgtcaactcatagtcatagaggcttttattatcttcttataagtacacttaaaacacatttgacatagattgtcacttattattcaaaccgtaaaatgtccataaccattaattatatctcaatatactactagactatgcacagtttcaagagttttgcgtgctagtagggcttgagatgtaactagcaactattacaatcatgaatcctctaaaagtaaattccgatgaatttatacctgcttcaaggtaaatgatacggatgagaacaaacggagttatcttgacaccatcaacaatagaagggtattcccacaaagattgatccccagcctccttcctcgaaagataccataaaggatttatgcagcatataaggtatgtagcgtttaaaactaagtgacaaaaacacattagcaaggcataaaaatgtaaagtcatgaagatatgtaaaacatattgtggccgaactaagcctagagaatcaaatgcaaaacgatgaagaagcaggcctagacattaattagttcaacctaagtcctatgcacatgtcaacggaagtagcaacacgtggctgtcctatgaaggtccatgatcttgatctttcatttgcatccatattcccaatgtcgaaagtttgaggttgtagccatgggtagtgtttttgcttccattgagctcatgatactagcagtttctttgcattgtagatattgggatcatttggttagtttgaatctcactacattgtcttcagtttctacctattcaaggacaacctatttcttaacttctttaggagatagagtgtgaatgtctgtcaggtgtacacagctccaaacgaatgcgggtgaggattttgagattatgtaattgtgtcatcacggtgccctgattacagtagtgggaattgggttatagtcttctaaagcagtccgagagggcgcaatggatattcgtgttctatcattttatatgcaaggatgcaaacaataaaaagttaagacaagtgagatgagtagcaaatagctaaccaaactcaataatgttgctaggcccaatgaatctaagtttaaattcaattacaatggagaagtcttaagtttcgattgatatgaaatgtaccataacatatttattaataaaaaaacttaaatttaaaataaatatcatcatagcgaaattgaagcaacttttcaacaatctattagtacaaagcacaaattcaagcatcaagtttccaaaatgctcatttaactcaaattaaaattttcaatttgttgtcaacaaagacgagttgtcctgccactatctcgtcaactccaactttcttatatgacttggtatatttaggactattttatacttctgtatctctatttttttcttttgttaaatctaaaactcaaatgtacttatacaaacttgtatttgaacaatacctttccaaataacaattattatacaacatcactttgtatattttcacaaaacgaaaaatagcaaacccaaatattctcacaactacagataaaaattatcttaagtgaagcaaaagtttgccggtgtagtttaactaaatttgatattttttcttcgatttgtccgattccactgataaaataaatcacgatgaagctctatccaccaagtcaattcggctggaaagaactcgctgaactaatcccgatcaaaataaccgatataaccaactaaccaactaaccaactataccaataacatgaaccaatcttcggttgacaacataccgaacacaaccacaaaacaaaaaagcacactcaaatgccgtcataccttactaaatcaattgcggttccggttcatgagaaattgcttggttaaaccacaacccaacgcctcatcaggtaccttaccaatacggtttaatccctccgcgaaaaccacacccattcccatatgcaaatgcggttcaatgtgacaatgaaaaaaccaaacccctggattatccgtcacaaaccttatcgccgtccatccatacggatacaaaatcgccgtattccgtaacggcggattcttcaaattatacgtcttctcatcaattcccggtttaaatttcccgtcaccgtaacccaaaacccagaaatcgtgaccgtgaagatgccatggatgaatctcactaacaataccttttaaaacgttagcgttttggataatcacgtcgaccgttacattaaacgggaaaacgtatattccgtttcctgtagtggtgttaggaaacggcggtggattcataatatcgtaatccatacggtaactcctcggcggcgatttccggttaaatccgagtttcaagttgtatttaaccgaaccgagatacggcgttgccggagtcactagagagacgttgttgatcgcccatttcgtgtatccgtcgattagattctgtgtgttgagaagaatcaaccgttttctgtatttcttcggcggcgatggtgatcccatcgctgagaagatcttcttagagaaatttttgcttcgttcgaaatcgtcccaccgtggagtcaccggtggaggagaagaagggagttttgaagcaggggcagttacgtaatttaatatagtgagtgcctgagttgtgtttggtttccggccacggacgccgacggagatgtaatagttttgtgaagggtcttgatcggtggtgagaaggacggagtagctttcgccggagtatatgtcgatatcgtcggtcgtgaacggcgttatgtagttgccgtcggcttcgaccaccactagcttgtgtccctgcatgtgcaaaaatcaccacacgtgtgatcaaaagttttttattttgaagtctgtgttcccaaaaaaaaaaaaggaacgaaaatatgtaattgttcattttctttcttggaccgattactatagaattaggcctagtacaatgtgcccatataacacatcaaataaattattatcttccttttaggattttcccatttattagttttcgttcttgttaaaaacatgcattatgagtgtttcaaaccgaaaggttacactgtcggcactaatacgtcgtataattaaaacattacttcagaaaatcatatatatgaaagttggtcaactctctctgattgtcacatcaatacataaaaaaataatatatgtcatgttacattatttaacaaaaagtttagcataattcattgagagaaaatgaaaagtcttctaataatatcacttttaattactttttataacttttaaaaatacaaaatcagggtaaagtatcaaacactattttacaacttatcaatgacattttctcttttcatttttgtgtctaatggtaaattagtaacaatgaaatgtaagttttttcatgtaatgaaccattgagacattagacataccaaaaaattcaaaatacgagtctctatagctatatagaaagagagaaatctaaagtgtttaatcaaattactagcacatcatgatgtggttggaataaagaattgtttatttaagatcaagttagacaagttttaaacaacataagtaacataattacatacaactgtatcaatacattctatattattgttgtatgtattcataatagtgaaagattagaatcttaagtctataaataatcagatttatacgtgagaaaagtataattaatatttcgagttaaggattaatctaactattacaattataactatatgaaaacaaaaataaataaaaacatataaaaattgaatcaaaggactaagaatcttgaacaacaacaaaaaacactattgaagctcattggttttttcttatgcactaatatagctgaacttttaaaaaataattacaagtcatatttacgttttaaaaataatacattcaaatttactttataaaaaaatatattatataaagtatttataaaatagtaacacatagattcgcacataatgcgggtattcatctagtatatggtaatacacacaatagctgaatagaaaggctttttagcaaaaatgaattgaacatgagtttgcgtgtcaaaactcaaaagtctaaagtaacactgaggccatctctacctacttgatagattgattgagacctcttagtcaaatccctacggaacgttgcacacatctcaatacaatacataacttttgtggtgtaaaatactacatactataaaattctactttgttttcactgtggacctacccccatcactttccagtccagtgagtaccagctcatactactgtctatactatcaaaagagtttaggatagtccatcattctttttaattttgttctcttttagttattaataaatcacctctatttgaagaaaatttcccactatgatactattttgttggtaggtattggctaattggcaatcttcattgactttcagccagaaaaaaccgtcgggtatgaaatttgccaaaagactcgtgacccataagtcaaaaatcattaaattattttggcaacatatagaaaatcgatcatattttatgttttaatatatagctaaagtccattgctattttggctgttttttgcatatgattgaatacttcaagtttggtttttgtttttagtttgagaatttcctactgaataatgaaaatggagatataaaataaaatggaaaaaaagtaaaaacctgaacagccaagttgagggaggcaagagcggtggtgctggagagtctgattcggtaagtcttgttcggctccacgtggagtatctgtggggcgcactgatcaccttctttaaacgtgcacattggtaatgattgtgttgttgctaaattgcgccgctaatgaacaattgaattgtcccctcccatttatcaatatgctcttcaatttttcatcaaaacaaatatgatgcatatattagaaaactctaagcaaaagaataatttattctttttttctcgctttaaagaaactcagtggccaatctattcacattcgaagaatttgctacttgttagaattgctttaaaagagaaatatagaaatcattatgcctatgttcaaaattcctttcccaaaaaaaaaaagaagttgatatgccagctgtactattgcttgtgcaaattgctctttatctcaatcaatctccattctccactattaaaaaagaaaaaatgcacctacttttttgtttttgtttttaaaacaaattttgaattttttttagtaaattgatattgttttagtaagtaaaaatagtaaagagatagtaaaaaaaaaagaacctgagcttcaccgatccagcgcataggtttggaagaaagaccgagttcttgggagggaatagcctcatgccaccagtcactgagtaagagattaaactcaccatcgtatctcaatctctcgctctttcctttagccacgtccacaatcaacgatccgtatagcccagctgatctctgcatgccatagtgtccatggtagaaatgtgttcccggctgcaccatttcatttatccccaaatttgttactatttatttttgttacaataatggaaaaagagaagaagaaaaaagttaccttttcaacagtgaaattgtaggtaaaagtctctccagggttaattgcgcattgagtaactcctgctgctccatctgcccatggacttccgaactatattcacaaaacgcagttaaagtattcagtcatctactaagtagtaactttacactgaattaggctttaggaatgcaaaataaggtaaattatagagtagtgtcaatgtactattttgttgcgataattttaagggacaataaatagtgtttatgggaaaagcaaacgtcgtaaatgaagttattgaatcaagaagagacaaagtgatcatgcatggcatgtgctgcttaacccattatttctgcaacttcacccattttctttcttcttttatcatctaatatcatgacaaatcataccaatctacaattctttatacaatggacacaatcattgaattaatgtatagagaaaaaagaaaacaaattaagcagaagaaaatagaagatctgaaaaagttcatatggtaagtgatgatccgagtgatgacacttagtgtatccatcttaataataacttctgttgtgtttacaaaatactcggcgctttctagatccatgatctggttatagtgaaaaaaaagagagagaacctgacggattccatgccaatggatgacaaggccttcggtggtgagtttgttggtgagattgacgacgatggtgtctccggcgaaggcttttatggtgggaccaggaaactcgccgttgacggtcataacggcgccctctttgcagtccggcgaccaatacttgtactccacctcccaatgatattctctcacggcggcagacgccgtgtgagtcaagacagccaccaccagcactatccaccacacacccatttggcttatgtatgtgaatgatgatgatgtgtgctcatcataagacatatatataggaggagagaggaagagatagtgggcaaaaccatagattgggttttttggtcaaaaaggctatttatttattttttctttaaattttagggttttaga

SEQ ID NO: 1356 - DNA, 1558 bp, Arabidopsis thaliana
  G939 DNA sequence used for BLAST
tttactgaatccaagatgtgggcaactcttgcccttgattatgcagattgttctctgttcctactgtttcctcacctccattgaagtcagtaggtaagactaaaccaagattctgattcagcgtcgaaggagaaggattcaaatcctcaaccaagtcatcgttgcctctttgtggagcttttggtctgtagagatcgttgggatgattaaactggtcttgaaagctctgaacctgctgctgcatcccgttataatccggacaaggaaccattaaacccgtcataccatagggtttagttggttggtagaaggaagtgactttataaggacaagtcatttggtgattctctcttaagttcctgtcaagaaatcccatatgtggttggctataaggacagagactgttctcacatgttaggagtgttggatgcattggcatcccaaaatcttcttcaaactttctcttgtaaacacagttgtagttgttttcaaattcaggatactgctgattggtccgatgagtgccaccaatcagttcaacatcatagtctgtagattcaggaaacaaaacatctgggtctccaccggttgcaggaacaagaaagttagaagtgttgttgttttctctagacatggctatttgatcaacaatagccttttctcggtaaagagcagcgagccataaagcgccttctcttgacgtcattttctcctgcaaacttctagaccgtctcacgagattgggtatgttgctaatgtcagaagccatatgtctgattacaccaatcaaaacaccaattttccacagcttcttgagatcatgaggcttcttgtaaggtggcggaacacctcgaaaatcaacgggtaaagacagttgatcccaccaatcttctttccccgttggccaccatggcggtgtcacgcctttctccaacggaaaccgcctctgaggagggttgcagtgaggaaacagagccgataacagagctccaagagtagtatcttgaagctcaagcaacttctgtgcggtagaatccccaacctcagaccctgaatcacttccatcagaaagattgatatccctttggtgcttgattatagcagctgggccgttcctatcaaacctcactttgtctttccaccattcacggagattatcagaagatcccgctaccgttttcccattctctaacacaatcccataaacaaaaccttgagctttatatcgctccattgtcttcgacatgtacttcaagatcccatcttgtgccttgtacatggttctcttactagagtgctctggaaaatcatcatgttgctgcttcaacaacaatcttgttcctagaccgttcttcgccatttccttgagccgctttaaacgctgcttgtctctccagatcttcttctcaagctcctctatttccatttcctcatcactactcagatcatcgcacaaagccgtatgcgaatcagaacacatatgtccctctgtaaatggaggcgccgagctacaaactaaactccggaacatccctatattgttgttatacatatccat

SEQ ID NO: 1357 - DNA, 2310 bp, Arabidopsis thaliana
  G941 cDNA Sequence
tcttcttcttcttcctcttcctcatctcgtatctctaacttttgtcgaagttcttttgatgaaactagggtttattatcttctccttctttttcccatcaccatagaaaaggcagagacctttttcttcatcatttttattctccttcttcttctgctgttcatttctccaggttacaatgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaaagtcttggtagtagatttcatcttctcttatttttatcttttgtgttcttacattcactcaaccatgtaatattttttcctgggtctctctgtctctatcgcttgttatgatgtgtctgtaagagtctctaaaaactctctgttactgtgtgtctttgtctcggcttggtgaatctctctgtcatcatcagcttttagttacacacccgacttggggatgaacgaacactaaatgtaagttttca

SEQ ID NO: 1358 - protein, 628 aa, Arabidopsis thaliana
  G941 Amino Acid Sequence
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 1359 - DNA, 3387 bp, Arabidopsis thaliana
  G941 Genomic Sequence
agagcagtgagtattgccaaaaggcgctttgttaattacatattaattgtgtaataataataataaatgatgtcttaaattttatgtgtaagaaatgaaattaaaatgatatatatgtatattatatatctaaacatatatatatatatataaatagagtatatatactatgatctatcttcctgatctacagagagactccacaaagaaacgcaaataaacaaaagtcgctttctagccacgtgatctttcgtcgacttttcttcttcttcttcttcttcctcttcctcatctcgtatctctaacttttgtcgaagttcttttgatgaaactagggtttattatcttctccttctttttcccatcaccatagaaaaggcagagacctttttcttcatcatttttattctccttcttcttctgctgttcatttctccaggtactatacgcttcttcttctattgattttttagggttattattgatactgaagatgatgataggtttattcatagggttttactagatcgatggttttactttagtttactagtgtttacacgatctaatttcatgagtttatgctacttttagttttttttttgggtgaagttttgtttattgtttataaatcgttgatctatttgaaaatgttttctctttcttattcatatatgatcctttctatatttggttcctatgttgaagatctcatcctttttttggaaattgaatctgttgataatttttattatccgattgattatttagtttaggagtgattaaaatacgatctgattatgtgtttattacttaaaactttgattgaattcgaaaagccccttttttataatttagggtttgatgattttttttagtaagttgtttgattcagaagaaatataattgtactgattagttttgtttgtgtatttgatttgttacaggttacaatgatgtttaatgagatgggaatgtgtggaaacatggatttcttctcttctggatcacttggtgaagttgatttctgtcctgttccacaagctgagcctgattccattgttgaagatgactatactgatgatgagattgatgttgatgaattggagaggaggatgtggagagacaaaatgcggcttaaacgtctcaaggagcaggataagggtaaagaaggtgttgatgctgctaaacagaggcagtctcaagagcaagctaggaggaagaaaatgtctagagctcaagatgggatcttgaagtatatgttgaagatgatggaagtttgtaaagctcaaggctttgtttatgggattattccggagaatgggaagcctgtgactggtgcttctgataatttaagggagtggtggaaagataaggttaggtttgatcgtaatggtcctgcggctattaccaagtatcaagcggagaataatatcccggggattcatgaaggtaataacccgattggaccgactcctcataccttgcaagagcttcaagacacgactcttggatcgcttttgtctgcgttgatgcaacactgtgatcctcctcagagacgttttcctttggagaaaggagttcctcctccgtggtggcctaatgggaaagaggattggtggcctcaacttggtttgcctaaagatcaaggtcctgcaccttacaagaagcctcatgatttgaagaaggcgtggaaagtcggcgttttgactgcggttatcaagcatatgtttcctgatattgctaagatccgtaagctcgtgaggcaatctaaatgtttgcaggataagatgactgctaaagagagtgctacctggcttgctattattaaccaagaagagtccttggctagagagctttatcccgagtcatgtccacctctttctctgtctggtggaagttgctcgcttctgatgaatgattgcagtcaatacgatgttgaaggtttcgagaaggagtctcactatgaagtggaagagctcaagccagaaaaagttatgaattcttcaaactttgggatggttgctaaaatgcatgactttcctgtcaaagaagaagtcccagcaggaaactcggaattcatgagaaagagaaagccaaacagagatctgaacactattatggacagaaccgttttcacctgcgagaatcttgggtgtgcgcacagcgaaatcagccggggatttctggataggaattcgagagacaaccatcaactggcatgtccacatcgagacagtcgcttaccgtatggagcagcaccatccaggtttcatgtcaatgaagttaagcctgtagttggatttcctcagccaaggccagtgaactcagtagcccaaccaattgacttaacgggtatagttcctgaagatggacagaagatgatctcagagctcatgtccatgtacgacagaaatgtccagagcaaccaaacctctatggtcatggaaaatcaaagcgtgtcactgcttcaacccacagtccataaccatcaagaacatctccagttcccaggaaacatggtggaaggaagtttctttgaagacttgaacatcccaaacagagcaaacaacaacaacagcagcaacaatcaaacgttttttcaagggaacaacaacaacaacaatgtgtttaagttcgacactgcagatcacaacaactttgaagctgcacataacaacaacaataacagtagcggcaacaggttccagcttgtgtttgattccacaccgttcgacatggcgtcattcgattacagagatgatatgtcgatgccaggagtagtaggaacgatggatggaatgcagcagaagcagcaagatgtatccatatggttctaaagtcttggtagtagatttcatcttctcttatttttatcttttgtgttcttacattcactcaaccatgtaatattttttcctgggtctctctgtctctatcgcttgttatgatgtgtctgtaagagtctctaaaaactctctgttactgtgtgtctttgtctcggcttggtgaatctctctgtcatcatcagcttttagttacacacccgacttggggatgaacgaacactaaatgtaagttttcataatataaatatatttgcaagctctcttcttctgtgtgttttggttgagtttgacttttacaattgaaaagtttggtgtaattcacgctaactacctcaaagttagggaatggtgggataattatttattacaattgtatttgatggataacgtgcttatcgctagtggctcgcgggtagcatttaagcatgggtcaatgcttgtgtctacgagctcgagtgatcgagcacacacaatccaatccgaacacaaaacaagaagaaaaacaaaataagatcttagatgtaaggtattcttaaat

SEQ ID NO: 1360 - DNA, 1887 bp, Arabidopsis thaliana
  G941 DNA sequence used for BLAST
ttagaaccatatggatacatcttgctgcttctgctgcattccatccatcgttcctactactcctggcatcgacatatcatctctgtaatcgaatgacgccatgtcgaacggtgtggaatcaaacacaagctggaacctgttgccgctactgttattgttgttgttatgtgcagcttcaaagttgttgtgatctgcagtgtcgaacttaaacacattgttgttgttgttgttcccttgaaaaaacgtttgattgttgctgctgttgttgttgtttgctctgtttgggatgttcaagtcttcaaagaaacttccttccaccatgtttcctgggaactggagatgttcttgatggttatggactgtgggttgaagcagtgacacgctttgattttccatgaccatagaggtttggttgctctggacatttctgtcgtacatggacatgagctctgagatcatcttctgtccatcttcaggaactatacccgttaagtcaattggttgggctactgagttcactggccttggctgaggaaatccaactacaggcttaacttcattgacatgaaacctggatggtgctgctccatacggtaagcgactgtctcgatgtggacatgccagttgatggttgtctctcgaattcctatccagaaatccccggctgatttcgctgtgcgcacacccaagattctcgcaggtgaaaacggttctgtccataatagtgttcagatctctgtttggctttctctttctcatgaattccgagtttcctgctgggacttcttctttgacaggaaagtcatgcattttagcaaccatcccaaagtttgaagaattcataactttttctggcttgagctcttccacttcatagtgagactccttctcgaaaccttcaacatcgtattgactgcaatcattcatcagaagcgagcaacttccaccagacagagaaagaggtggacatgactcgggataaagctctctagccaaggactcttcttggttaataatagcaagccaggtagcactctctttagcagtcatcttatcctgcaaacatttagattgcctcacgagcttacggatcttagcaatatcaggaaacatatgcttgataaccgcagtcaaaacgccgactttccacgccttcttcaaatcatgaggcttcttgtaaggtgcaggaccttgatctttaggcaaaccaagttgaggccaccaatcctctttcccattaggccaccacggaggaggaactcctttctccaaaggaaaacgtctctgaggaggatcacagtgttgcatcaacgcagacaaaagcgatccaagagtcgtgtcttgaagctcttgcaaggtatgaggagtcggtccaatcgggttattaccttcatgaatccccgggatattattctccgcttgatacttggtaatagccgcaggaccattacgatcaaacctaaccttatctttccaccactcccttaaattatcagaagcaccagtcacaggcttcccattctccggaataatcccataaacaaagccttgagctttacaaacttccatcatcttcaacatatacttcaagatcccatcttgagctctagacattttcttcctcctagcttgctcttgagactgcctctgtttagcagcatcaacaccttctttacccttatcctgctccttgagacgtttaagccgcattttgtctctccacatcctcctctccaattcatcaacatcaatctcatcatcagtatagtcatcttcaacaatggaatcaggctcagcttgtggaacaggacagaaatcaacttcaccaagtgatccagaagagaagaaatccatgtttccacacattcccatctcattaaacatcat

SEQ ID NO: 1361 - protein, 557 aa, Arabidopsis thaliana
  G942 Amino Acid Sequence
MVEVQDLEPLSPIQDYDEDDLEEDVDEFERFGEEISYDDLKKRMWKDRNLMCKLKQQKRDNLNSVISSPSSSTSASSSSSSSVIVRRTEASRRKKMARSQDSVLKYMMKIMEVCKAQGFVYGIVPEKGKPVTGSSDSLRRWWKENVQFDQTAPNAVSDYLTLAAAQLISSNESLDPNSYIHMLHELQDTTLGSLLSALMQHCVPPQRRFPLEKGLAPPWWPNGTELWWGEQGAAAFEHGPPPYRKPHDLRKAWKVSVLAAVIKHMSPNLERVRRLARQSKCLQDKMMAKETDTWSRVLNQEEARLNRLKISDDEDEDRDQEQARFTCFDQEPSLNTCFIVGQDQEPLGSMRKDKRVDQEFSSNDCFLVAQDQEPRKGKKADQEWSPNSCFLVDQEPLGNKRKGEFVEKEAMLSNVYTCQNSSCPSSDVSLGFVDKNLRTGHEIECLYGTPELVNQSSGGGSDGFVRSITTSDDDYSASSKAEDTRDYHNQDGNWLDYLWFERLHDLNFSDQGFEDQTSTVDLNQLPDHSDSNQTMNEDDISLWDMGCEDKDIYMSQD

SEQ ID NO: 1362 - DNA, 1671 bp, Arabidopsis thaliana
  G942 Genomic Sequence
atcttgagacatataaatatctttgtcttcacaacccatgtcccataacgagatgtcatcctcgttcatggtttgattggagtcagaatgatctggtaattggttcaaatccactgtgcttgtttgatcttcaaatccttgatcagaaaaattcaagtcatgtaacctctcgaaccagagataatctagccagtttccatcttgattatgataatctcttgtgtcctctgctttcgagctggcgctgtaatcatcgtcactcgtagtaatcgaccgaacaaacccatccgagccgccaccactactctggtttaccagttctggagtcccgtaaagacactcaatctcgtgaccggttctcaagttcttgtccacgaatcctaaactcacatcactcgaaggacaactcgagttttggcaagtgtatacattagataacatcgcctctttttccacgaactcaccttttctcttgttacctaatggttcttgatcaacaagaaaacaagaatttggagaccattcttgatcagccttttttcctttcctaggttcttgatcttgcgctacaaggaaacaatcgttcgaggaaaattcctgatcaacccttttgtctttcctcattgatcccaacggttcttgatcttgccctacaataaaacaagtgtttagagacggttcttgatcaaaacatgtgaatcttgcttgttcttgatctcgatcctcgtcttcgtcatctgagatcttgaggcgattgagacgagcttcttcttggttcaacacacgagaccaagtatcagtctctttcgccatcatcttatcttgcaaacactttgactgtctcgcgagccgtctcactctctccaaattcggcgacatgtgtttaatcacagccgctaaaacgctcactttccaagcttttcttagatcgtgcggtttgcgatatggaggtggaccgtgttcaaacgccgcagctccttgctctccccaccataactctgtcccgttcggccaccacggcggagccaaacctttttccaacggaaaccgtcgttgtggcggcacgcaatgttgcatcaaagctgataacaatgaccctaacgtcgtgtcttgtagctcgtgaagcatgtggatatacgaattcggatctaaagattcgtttgatgagattaactgagcagccgctaatgtcaagtaatcagaaacagcgtttggagcggtttggtcgaattgaacgttttctttccaccaacgtcttaaactgtctgaagaaccggttaccggtttacctttttccggtacgattccgtaaacgaatccttgagctttgcaaacttccattatcttcatcatgtacttcaacaccgaatcttgagatcgagccattttcttgcgccgtgaagcttcagttcggcgcacgataacggaggatgatgaagaggatgatgctgacgtggaagatgacggcgaagagataacggagttaagattatctcttttttgctgtttaagcttacacatgaggtttcgatctttccacatgcgtttcttgagatcgtcgtagctgatttcttcaccaaaacgttcaaattcgtccacgtcttcttcgaggtcatcttcatcgtagtcctgtattggactaagtggttctaaatcttggacctccaccat

SEQ ID NO: 1363 - DNA, 1671 bp, Arabidopsis thaliana; identical to SEQ ID NO: 1362
  G942 DNA sequence used for BLAST

SEQ ID NO: 1364 - DNA, 1652 bp, Arabidopsis thaliana
  G960 cDNA Sequence
taccgtcgacccacgcgtccgagtgtattcaaagtcggaaagaaaccctaaagaagaggattatgggtgctgtatcgatggagtcgcttcctttaggtttcagattcagacctaccgatgaagagctcgtcaatcactacctccgtctcaagatcaacggacgtcactccgatgtccgtgtcatccctgatatcgatgtctgcaaatgggaaccttgggatcttcctgctctctcggtgattaagacggatgatccagagtggttctttttctgccctcgtgatcggaaataccctaatggtcatcgctctaacagagcaactgactctggctattggaaagctactggtaaagatcgtagcatcaagtctaagaagactttaatcggtatgaagaagactcttgtcttctatcgtggacgagctcctaaaggtgagcggactaattggattatgcacgagtatcgtcccactcttaaggatcttgatggcacttcccctggccaaagcccttacgttctttgtcgcctcttccacaagcctgatgatcgggttaatggtgtcaagtccgatgaagcagcttttacggccagcaacaaatactcacctgatgatacatcatctgatcttgttcaagaaacaccttcctctgatgctgctgttgagaaaccatcagattattcaggtggatgcggttatgctcatagtaatagtaccgcagatgggacaatgattgaggcacctgaagagaatctttggttatcttgtgaccttgaagatcaaaaggcaccactaccgtgtatggattctatatatgctggtgatttcagttacgatgagattggattccaatttcaagatggtaccagcgaaccagatgtatcactaacagaattgttggaggaggtgttcaataaccctgatgacttctcttgcgaggaatcgatcagtcgagagaatccagcagtctcaccaaatgggatattttcatctgctaaaatgctgcagtctgcagcaccagaggatgctttcttcaacgacttcatggctttcactgatacagatgctgagatggcgcaattgcagtatggttcagaaggtggagcttctggttggccaagtgacactaattcatactatagtgatttggttcagcaagagcaaatgatcaatcataacacagagaacaacctcacagaagggagagggataaagatccgggctcgacagcctcagaaccggcagagtacaggattgataaaccagggtattgctccaaggagaatccgtctgcagctgcagtctaactctgaagtaaaagaacgagaggaggtgaatgaaggacacactgttattcccgaggccaaagaagctgcagctaaatactcagagaagagtggttctttggttaaacctcaaataaagctcagggcgcggggaactataggccaagtaaaaggagagagatttgcagacgacgaggtacaggtgcagagcacaaagagagagagagagagaatcaaatgtagtttaatgtaattagggatgatgcaatgttagcatgtttgtgtgttgtaacttaaaaacttatttaggaatctgataaaagttactgttgaaaaaagaaaaaaaaaaaaaaaaaaaaaaaaaaaa

SEQ ID NO: 1365 - protein, 491 aa, Arabidopsis thaliana
  G960 Amino Acid Sequence
MGAVSMESLPLGFRFRPTDEELVNHYLRLKINGRHSDVRVIPDIDVCKWEPWDLPALSVIKTDDPEWFFFCPRDRKYPNGHRSNRATDSGYWKATGKDRSIKSKKTLIGMKKTLVFYRGRAPKGERTNWIMHEYRPTLKDLDGTSPGQSPYVLCRLFHKPDDRVNGVKSDEAAFTASNKYSPDDTSSDLVQETPSSDAAVEKPSDYSGGCGYAHSNSTADGTMIEAPEENLWLSCDLEDQKAPLPCMDSIYAGDFSYDEIGFQFQDGTSEPDVSLTELLEEVFNNPDDFSCEESISRENPAVSPNGIFSSAKMLQSAAPEDAFFNDFMAFTDTDAEMAQLQYGSEGGASGWPSDTNSYYSDLVQQEQMINHNTENNLTEGRGIKIRARQPQNRQSTGLINQGIAPRRIRLQLQSNSEVKEREEVNEGHTVIPEAKEAAAKYSEKSGSLVKPQIKLRARGTIGQVKGERFADDEVQVQSTKRERERIKCSLM

SEQ ID NO: 1366 - DNA, 2211 bp, Arabidopsis thaliana
  G960 Genomic Sequence
ttaaactacatttgattctctctctctctctctttgtgtctcatgtgtcatgaactcaccagtgtcctccatatacccatccctaccccaaccatcacagccaccattaccgttgcaaccaccttccatcgcttccctcctcgtctctttctgctctgcacctgtacctgtaaccacaacaaacttctctttagacaaagatacttctcagtttcttttatcattactagctgatctcacatgctctactgattgctttctcttttttttctttctaattctatagtatttagtagagcttactactatactctttcttcattcatgtgtaaacaagttcactcattcttacctcgtcgtctgcaaatctctctccttttacttggcctatagttccccgcgccctgagctttatttgaggtttaaccaaagaaccactcttctctgagtatttagctgcagcttctttggcctgcacatccccaccattaacaacaaattaaaaagatgcatcctttatgttattgatgtctaagacacaacttttggaatcactagtctcgtacctcgggaataacagtgtgtccttcattcacctcctctcgttcttttacttcagagttagactgcagctgcagacggattctccttggagcaataccctggtttatcaatcctgtactctgccggttctgaggctgtcgagcccggatctttatccctctcccttctgtgaggttgttctctgtgttatgattgatcatttgctcttgctgaaccaaatcactatagtatgaattagtgtcacttggccaaccagaagctccaccttctgaaccatactgatcaaacaaaagataaaaattgtcattttacttatgtcaagagtgattgtaaagataactgatctagaggtttctagcctacttaaagcaaaataatttggatacttctaaaattgtataggcctcaaaatatgtatctttgtgctcacctgcaattgcgccatctcagcatctgtatcagtgaaagccatgaagtcgttgaagaaagcatcctctggtgctgcagactgcagcattttagcagatgaaaatatcccatttggtgagactgctggattctctcgactgatcgattcctcgcaagagaagtcatcagggttattgaacacctcctccaacaattctgttagtgatacatctggttcgctggtaccatcttgaaattggaatccaatctcatcgtaactgaaatcaccagcatatatagaatccatacacggtagtggtgccttttgatcttcaaggtcacaagataaccaaagattctcttcaggtgcctatgaacacaaaactcaaaattagtcaagtcactcaaaaaagcctaattaattattcaagagtttccattcatacctcaatcattgtcccatctgcggtactattactatgagcataaccgcatccacctgaataatctgatggtttctcaacagcagcatcagaggaaggtgtttcttgaacaagatcagatgatgtatcatcaggtgagtatttgttgctggccgtaaaagctgcttcatcggacttgacaccattaacccgatcatcaggcttgtggaagaggcgacaaagaacgtaagggctttggccaggggaagtgccatcaagatccttaagagtgggacgatactcgtgcataatccaattagtccgctcacctttaggagctcgtccacgatagaagacaagagtcttcttcataccgattaaagtcttcttagacttgatgctacgatctttaccagtagctttccaatagccagagtcagttgctctgttagagcgatgaccattagggtatttccgatcacgagggcagaaaaagaaccactctggatcatccgtcttaatcaccgagagagctgccgacaatcagatttgtttccaattgagtaaagaaaaaaaaggtggaatctttgagagggaaaacagaatctgagaataaaaggaatcaaattttgagagaataaagagacgaaccaggaagatcccaaggttcccatttgcagacatcgatatcagggatgacacggacatcggagtgacgtccgttgatcttgagacggaggtagtgattgacgagctcttcatcggtaggtctgaatctgaaacctaaaggaagcgactccatcgatacagcacccat

SEQ ID NO: 1367 - DNA, 2211 bp, Arabidopsis thaliana; identical to SEQ ID NO: 1366
  G960 DNA sequence used for BLAST

SEQ ID NO: 1368 - DNA, 1221 bp, Arabidopsis thaliana; identical to SEQ ID NO: 32
  G964 cDNA Sequence

SEQ ID NO: 1369 - protein, 283 aa, Arabidopsis thaliana
  G964 Amino Acid Sequence
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 1370 - DNA, 1143 bp, Arabidopsis thaliana
  G964 DNA sequence used for BLAST
caaaattcagcccatgagccacctgaccagcacaagcaacccacggattgatagaaacgggcctgtgattgtggtgatggttcgatgatgatgggccacccacacgctcgcacgaaggacacatgatgagtgtagttggtggagtcatctgaccgtagaattgtggagacagcttgagagttcgaagctccatagcctctttctgaagtctccggttctcttccgttagcttctctacgcaccgtttcaagtattcgcaatctacctccgtttgctttaacttggttctgtaaaaccaaatcggaccttgtaagtaaaaacttctacacaagggggtataaatgtaattttacaattttggtgttaagacaagaaaatctcacctagctcttctgttttggaaccacacttccacttgtcttgccgtcaagttcagcttcttagccaaagctagcttctgtttctgtaaattatgataataaccttggttatttcaaagtaattacgataattatcatttgattcctctgacttttttacacttacgggattgagagtgttgtgttctttgaaagtctcttcgagaaaagcagactgatcttttgataacctgagcttcttcctcgacgtttcgcccccgtcttcttcttcatctgaggttccacgtgagtaccctcgatccggagtgatctcgtcgtgatcgtcgccggagccaacgccggttccggagattccttctctctcacttctcttcccgctaatggtgcttgagatcgtactgtttggtgacgaaactcctgtgtcttcctcgcagttaaccgttgatggaaaactgttcacgtctatcttgcgaagatctgcaaagagcaatcaaattttaagtttgagatctgtttttattttacttggaaacgaagaaaagtctcatacttcaattctgaaatctgttctgtttctttaaaaaaaaaaacagagaagatttaagtatatacctgatgtaggatcgaatgtttggttccatgggagtctctggagattgtttgataatgaagagttaggattcagattcatctgaagaggattgtgattttgtgaaaaccctaagcttaggctcaaacctagatcttctttgcccatcatcat

SEQ ID NO: 1371 - DNA, 1983 bp, Arabidopsis thaliana
  G965 cDNA Sequence
gattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaggaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatc

SEQ ID NO: 1372 - protein, 627 aa, Arabidopsis thaliana
  G965 Amino Acid Sequence
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 1373 - DNA, 5386 bp, Arabidopsis thaliana
  G965 Genomic Sequence
gctcatcatcaatcatttctttaattctctgcaactccaaggtacttcctctctctctctctctctctctctataccatatatgtagatgatgaccgaagctgaaagtgagaaccttaaaagagttacaagaaagagattggagaaaaactgtataatacctagttgactcctctctctctctctctctttctttttcttgtattttttttttgtatgtgttatataagattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaagaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtaacgttttcactcaatattttttctctaaccaaactaattaattttctatcaaacttttaatgaaccgttctaatgattgaattgatcaaacaaccaatttcatatcaatcgctacaaaattttatttttcttcgtgatttttttcttcttatataattaattctaaatcgaccaatattttcataaactctatatatgttattttcttaaaaaaataaatgtatagagaatgaccgactggtacaagagcacgacacatgctctagttggtaaagcctgattacgcaatcctactatcacttatataatttttctaactaatatcattatatggtgttatatggtctaatttgatatattaatgcatattttgtgtcacgcgtttggtggcatcgcttaatcaaatttaacataagaaattaatatatgattgattaagtgatttagtcttcacaaccataaattttaaattagagtttccttctccatataagctagccaccttcactacgtaaccaaaactagtccttgaagttacttcattatttatcttacaatttattttgtagttgacattatcttctttcaagaatttagtatatgttccaagatagcataaattgttagcaagagaagataacacattgaagtatctaaacgaactaatcacttgaggtttatattttatcttagaaattgagctaataaaaaaaaaacaagaactcatctatgtatagttcatttatttaaaatttaatttgtaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtaagtccattttctaatcccttaataatacttacctactcttattcttcgataatactaatcttcttgaatgttgactatacattataaaatgtagactaccataatgcattgataccaagactttaactaatatacgtttattaaacttaagttatgaaagtgacaaaaaaatttttttttttataactcttttgttatgcgggaagatatatttctatttcaatcaaaattaaaagctgctggcttttttagaaaaccaaaataatttttgtaaaatgaagttccgtttcttcactgagtttgattattttatgtttattactactaataaaaatttaaatatcaaatattttttccttttcataccacccataagaatggtcagctaagagtactccaaaataacaagggtaacaattcattgactaggagactttcatgaaaactgtatgtttatatttatattaatgtaggttatattgcatggcaaattaaagggtttaaataattaatgcaacaaaagaagtttgcagagtgagatcgcaaacttttatgctttgggatcataatagcatcctaagggtttctctgtctctgcctaacctttcctttatagtttttttttctttaatttgctttaattcattccacatactattatcaaaagaagtaacaatgccattaacataactacaaaaaaataagtctcagatttgtcagtggtacagtttcattggtatattgtcccttaagaaagacagaaatcaaaaagaggaaaaaaaaaatctaaaagctgaaaaaagcaatttcttctgtcattattcatcagtactttctctatttaatgtctgcagaattttactattttgttgttagtgaagtaaagaagagaagagttgtacagataaatattttgctttatgatgaaaaataagttaagatacaaaaataaaataaaatgcttctattctgaaatcagctttttcttttgtcccttagattctcacgcccttgtaaggagaaagtttgtaccttttcttgcatctacttgattgtgtttttcctctctatctatattcaaaaaaagagaaaagaaaaaaattattggtttagggttctaaagattgtgaagtcattttctggtctctttctcaggtacccaagcgatgctgataagcacctcttagcacgacagactggtttatccagaaatcaggtcagcctttatctatatagatacatacatcaatatttttttaatataatatgttttcatacttatcatacaagaacccttttaattactcatttacatatatgtacttaactcacaatttaccatatatatcaatcatttcatcatgcaaaatctgacatgagtggcttcatgtctattctcttgcatggattttcaatatcacgaatcatttgtttttcttggggttcgttttcttcattaaatacattatctacacttacacacacaaggatatataaaacataggagagagagatgtaagtatttctcaagtacatgaaagtttgaagctttcatttcaatgttaactagcagacctctaagtcttgtacacattaattatttacatcacaagtagtttattacacttggcttcaaatatccattagtatatttcaaccttcaaattgttgttttaacattattatgtttcatgtgttcaaataaaaaaacattattatgtttcaaatttttaatttagaaatttcatctaagcctttcagtaaatacataagttaacatcaaatcaaaattacttgaaacatgtcaaaagttatcttgttcttgtaagaatataatgaaaaatttaatatatatcttctttttaatagatgtctcaaaggaaacacatgtatcataatttttactcctttcctatcattttaacttaaggttttagctatcctattttttttgtttcatttgtttaaactaattttcttcacagtaaatgacttattattttaactttacttaatataaaacaaatgaagtatatacaaaaacaatcaaaaccatatttaatgtaaaaaggagtatttcacatttcattgaaaagtttttttttccttctaaaagttaagtttcttttaatattataaacttgttaagagtaaattgtgattaatattagttcatatgtctcgttttttcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatcaaaatttattatagtgaattttatttttttggtttatcgatatatgtttttagtttcttcacatacttttaaaatttcctttcttctttagtttttttttctgtcttttctgtcgtaagaagaagagagatatacatatatcaagtgagatctagctaccaaagttccatatataattatgcacatatttttattttattcatgaaacttatatccttacatttttgtatagttttgttcatactaattttttgttcatattaatacccctgc

SEQ ID NO: 1374 - DNA, 4786 bp, Arabidopsis thaliana
  G965 DNA sequence used for BLAST
atgggtttagctactacaacttcttctatgtcacaagattatcatcatcaccaaggaatcttttccttctctaatggattccaccgatcatcatcaaccactcatcaagaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtaacgttttcactcaatattttttctctaaccaaactaattaattttctatcaaacttttaatgaaccgttctaatgattgaattgatcaaacaaccaatttcatatcaatcgctacaaaattttatttttcttcgtgatttttttcttcttatataattaattctaaatcgaccaatattttcataaactctatatatgttattttcttaaaaaaataaatgtatagagaatgaccgactggtacaagagcacgacacatgctctagttggtaaagcctgattacgcaatcctactatcacttatataatttttctaactaatatcattatatggtgttatatggtctaatttgatatattaatgcatattttgtgtcacgcgtttggtggcatcgcttaatcaaatttaacataagaaattaatatatgattgattaagtgatttagtcttcacaaccataaattttaaattagagtttccttctccatataagctagccaccttcactacgtaaccaaaactagtccttgaagttacttcattatttatcttacaatttattttgtagttgacattatcttctttcaagaatttagtatatgttccaagatagcataaattgttagcaagagaagataacacattgaagtatctaaacgaactaatcacttgaggtttatattttatcttagaaattgagctaataaaaaaaaaacaagaactcatctatgtatagttcatttatttaaaatttaatttgtaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtaagtccattttctaatcccttaataatacttacctactcttattcttcgataatactaatcttcttgaatgttgactatacattataaaatgtagactaccataatgcattgataccaagactttaactaatatacgtttattaaacttaagttatgaaagtgacaaaaaaatttttttttttataactcttttgttatgcgggaagatatatttctatttcaatcaaaattaaaagctgctggcttttttagaaaaccaaaataatttttgtaaaatgaagttccgtttcttcactgagtttgattattttatgtttattactactaataaaaatttaaatatcaaatattttttccttttcataccacccataagaatggtcagctaagagtactccaaaataacaagggtaacaattcattgactaggagactttcatgaaaactgtatgtttatatttatattaatgtaggttatattgcatggcaaattaaagggtttaaataattaatgcaacaaaagaagtttgcagagtgagatcgcaaacttttatgctttgggatcataatagcatcctaagggtttctctgtctctgcctaacctttcctttatagtttttttttctttaatttgctttaattcattccacatactattatcaaaagaagtaacaatgccattaacataactacaaaaaaataagtctcagatttgtcagtggtacagtttcattggtatattgtcccttaagaaagacagaaatcaaaaagaggaaaaaaaaaatctaaaagctgaaaaaagcaatttcttctgtcattattcatcagtactttctctatttaatgtctgcagaattttactattttgttgttagtgaagtaaagaagagaagagttgtacagataaatattttgctttatgatgaaaaataagttaagatacaaaaataaaataaaatgcttctattctgaaatcagctttttcttttgtcccttagattctcacgcccttgtaaggagaaagtttgtaccttttcttgcatctacttgattgtgtttttcctctctatctatattcaaaaaaagagaaaagaaaaaaattattggtttagggttctaaagattgtgaagtcattttctggtctctttctcaggtacccaagcgatgctgataagcacctcttagcacgacagactggtttatccagaaatcaggtcagcctttatctatatagatacatacatcaatatttttttaatataatatgttttcatacttatcatacaagaacccttttaattactcatttacatatatgtacttaactcacaatttaccatatatatcaatcatttcatcatgcaaaatctgacatgagtggcttcatgtctattctcttgcatggattttcaatatcacgaatcatttgtttttcttggggttcgttttcttcattaaatacattatctacacttacacacacaaggatatataaaacataggagagagagatgtaagtatttctcaagtacatgaaagtttgaagctttcatttcaatgttaactagcagacctctaagtcttgtacacattaattatttacatcacaagtagtttattacacttggcttcaaatatccattagtatatttcaaccttcaaattgttgttttaacattattatgtttcatgtgttcaaataaaaaaacattattatgtttcaaatttttaatttagaaatttcatctaagcctttcagtaaatacataagttaacatcaaatcaaaattacttgaaacatgtcaaaagttatcttgttcttgtaagaatataatgaaaaatttaatatatatcttctttttaatagatgtctcaaaggaaacacatgtatcataatttttactcctttcctatcattttaacttaaggttttagctatcctattttttttgtttcatttgtttaaactaattttcttcacagtaaatgacttattattttaactttacttaatataaaacaaatgaagtatatacaaaaacaatcaaaaccatatttaatgtaaaaaggagtatttcacatttcattgaaaagtttttttttccttctaaaagttaagtttcttttaatattataaacttgttaagagtaaattgtgattaatattagttcatatgtctcgttttttcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttag

SEQ ID NO: 1375 - DNA, 768 bp, Arabidopsis thaliana; identical to SEQ ID NO: 84
  G975 cDNA Sequence

SEQ ID NO: 1376 - protein, 199 aa, Arabidopsis thaliana
  G975 Amino Acid Sequence
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 1377 - DNA, 898 bp, Arabidopsis thaliana
  G975 Genomic Sequence
atggtacagacgaagaagttcagaggtgtcaggcaacgccattggggttcttgggtcgctgagattcgtcatcctctcttgtacctttcttctttctttcctttttctctgcgttgttcatttatttcctctctctgatccattaaagtacacaaccacacatacatatatatacatgatcgtagctaactcatttctggtttatcttcctttgttgttttcctcttcttagctaacacataaaatcattttaacatctagatacgtaaatatcaataagttattgcttaaaaattctactatatatatatatatatatatattcaccatgcttaattattaattttgacatgcgtgatgatctttcaaaataaaaaggaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaa

SEQ ID NO: 1378 - DNA, 898 bp, Arabidopsis thaliana; identical to SEQ ID NO: 1377
  G975 DNA sequence used for BLAST

SEQ ID NO: 1379 - DNA, 963 bp, Arabidopsis thaliana
  G976 cDNA Sequence
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatcttttttggatcctttgttcacgtttatgctagtcatctttgtttctttatcctatgattgttagagatgatttgttaaatatataatcgtaatgattttcacttttttttattcaaaaaaaaaaa

SEQ ID NO: 1380 - protein, 248 aa, Arabidopsis thaliana
  G976 Amino Acid Sequence
MADPNNPITEPKAIIQSSTSSSVTIVPVPTCGDSLSDSATCENPCPLDTITTTTTTVCFAAPSSTASGNDINTLMATDTDISRRKKNPVYRGIRCRSGKWVSEIREPKKTTRVWLGTYPTPEMAAAAYDVAALALKGGDTLLNFPDSLGSYPIPLSSSAAHIRCAAAAAAATRGAAGAAVKVGQKKEDKVYDTAESSTMGFVDEEELLNMPGLLADMAKGMMVAPPWMGSPPSDDSPENSDGESLWSY

SEQ ID NO: 1381 - DNA, 747 bp, Arabidopsis thaliana
  G976 Genomic Sequence
atggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattga

SEQ ID NO: 1382 - DNA, 747 bp, Arabidopsis thaliana
  G976 DNA sequence used for BLAST
tcaatagctccacaagctctctccatcagaattctctggcgaatcatctgacggtggagatcccatccacggtggagccaccatcatccctttggccatatccgctagcaaaccaggcatgttcaatagctcttcttcatccacaaaccccatagttgaagattccgccgtatcataaactttatcttccttcttttgacctaccttcacggccgctccagccgcacccctagtcgcagcagccgcagctgcagcgcatctgatatgagctgcggaagaggaaaggggaatggggtaagatcccagggaatccgggaagttcaagagagtgtctccacctttaagagctaacgccgccacgtcatatgcggcagcagccatctccggcgtcggataagtcccaagccagacacgtgtagtctttttaggctctcggatttcagacacccattttccactccgacaacgaattccccgataaaccggattctttttccggcgagagatgtcggtgtcagtggccattaaagtattaatatcattaccacttgcagtagaagaaggagccgcaaaacaaacagtagtagtagtagtagtgatagtatcaagtggacaagggttttcacacgtggcagagtcagagaggctgtcaccgcacgtgggaactggcacaatagtaactgacgatgaagtagaagattggattatagctttaggttcagtgataggattgttagggtcagccat

SEQ ID NO: 1383 - DNA, 833 bp, Arabidopsis thaliana
  misc_feature (810)..(810): n is a, c, g, or t
  G977 cDNA Sequence
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 1384 - protein, 181 aa, Arabidopsis thaliana
  G977 Amino Acid Sequence
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 1385 - DNA, 649 bp, Arabidopsis thaliana
  G977 Genomic Sequence
atggcacgaccacaacaacgctttcgaggcgttagacagaggcattggggctcttgggtctccgaaattcgtcaccctctcttgtaaaaactctccctcatcatcctctcaaattacgaaattaccctcggtcgctttttatttgagtaatgctaaacttttttgttttttttttgttttttttaggaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtga

SEQ ID NO: 1386 - DNA, 649 bp, Arabidopsis thaliana
  G977 DNA sequence used for BLAST
tcacagcgtctgagttggtaaaacagagcaaagctcaatggaaccgtagtgaagcagctcctcaatcatttgctcgatatgatcttcctccaatggcctaaaattctgttgcatattcgcatttccatcttcccacttgatctctgtcgtctccgttactcctctgttcaaatgactttcgttagccgtcacaccgtcactgtccgcggattgtgatcttgcggtctgcgtttgcgtttgtgtttgcgtttgcttggtcatttgaagagaagccatgtagcatttgtggagtttagcggtaagagttgctgatagaagcttggaagaggaagtaggaatggcattagggttgtatgggaaattagtacgagctctcgggccacacattagcctagccgcctcgtcgtaggcccttgctgcatcctccgctgtctcaaacgtccctagccagattcttgttttcctaaaaaaaacaaaaaaaaaacaaaaaagtttagcattactcaaataaaaagcgaccgagggtaatttcgtaatttgagaggatgatgagggagagtttttacaagagagggtgacgaatttcggagacccaagagccccaatgcctctgtctaacgcctcgaaagcgttgttgtggtcgtgccat

SEQ ID NO: 1387 - DNA, 1022 bp, Arabidopsis thaliana
  G986 cDNA Sequence
cattaaattggctcctgtgaacctaaatttatggactatgatcccaacaccaatccgttcgaccttcatttctccggtaaacttccgaaaagagaagtctcggcttcagcttctaaagttgtagagaagaaatggttagtgaaagatgagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttgactgtgaaagatggatatcaatggaggaaatacgggcaaaagattacgagagataatccatctcctagagcttacttcagatgctcgttttcaccgtcttgtctagtcaagaagaaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatgaaagttctctagaacatgtatatttctgttttgttctattttgttgctcattcctagtaaaaaggtaaagatttgtttgatcttgattaggaggcatagatgtcaattttaatgtgtgtgtatataattacatcaaatctaagtatccaaaaagggtcacccccattttatcttatg

SEQ ID NO: 1388 - protein, 271 aa, Arabidopsis thaliana
  G986 Amino Acid Sequence
MDYDPNTNPFDLHFSGKLPKREVSASASKVVEKKWLVKDEKRNMLQDEINRVNSENKKLTEMLARVCEKYYALNNLMEELQSRKSPESVNFQNKQLTGKRKQELDEFVSSPIGLSLGPIENITNDKATVSTAYFAAEKSDTSLTVKDGYQWRKYGQKITRDNPSPRAYFRCSFSPSCLVKKKVQRSAEDPSFLVATYEGTHNHTGPHASVSRTVKLDLVQGGLEPVEEKKERGTIQEVLVQQMASSLTKDPKFTAALATAISGRLIEHSRT

SEQ ID NO: 1389 - DNA, 1284 bp, Arabidopsis thaliana
  G986 Genomic Sequence
atggactatgatcccaacaccaatccgttcgaccttcatttctccggtaaacttccggtgagtttttcaatttcttcgaaaatttcacttcaattttcgaggttgtggtgattattcgtggtgttcatatatattttattgcctgatttagaaaagagaagtctcggcttcagcttctaaagttgtagagaagaaatggttagtgaaagatgaggttagttctttcatcgaacactttggtgtgcaatactttgacctcaaaatttttgactatgagtgaatggattaggttgatcaagttctcatatctgatttagacattgaatagtttgtttagatcggtgatgctcaaaagttgaacaaatcaaagctttgtcttacagcttagtttggtaatggtgattttcattttacacagaagagaaatatgctacaagatgaaataaaccgggttaattcggagaacaagaagctaaccgaaatgttagcaagagtctgtgagaagtactatgctcttaataatcttatggaggagttgcagagtcgaaagagtcctgaaagtgttaactttcagaacaaacagctaacggggaaacgaaaacaagaacttgatgagtttgttagctccccaattggactcagtctcggaccaatcgagaacatcaccaacgataaagcgacggtttcaaccgcttactttgctgctgagaagtctgacacaagcttggtaaggagatttctactacaagtatcgttctttgagtgtattgatttgttaacgaatgttttgtggatatacgttacttgtagactgtgaaagatggatatcaatggaggaaatacgggcaaaagattacgagagataatccatctcctagagcttacttcagatgctcgttttcaccgtcttgtctagtcaagaagaaggtactttggtttaaactttgttaaagagttcttcgatatcatcttgctgtctgattaaattccctagttgtgtgtgcgcttgtttaggtgcaacgaagtgcagaagatccatctttcttggtagccacttacgaagggacacataaccacaccggaccacatgcaagtgtgtccaggacagtgaaacttgatctagttcaaggtgggcttgaaccagttgaggaaaagaaagagagagggacgattcaagaggttttggtgcaacaaatggcttcttcgttgaccaaagatcctaagttcactgcagctcttgcgactgctatttccgggagattgatagagcattcaagaacatga

SEQ ID NO: 1390 - DNA, 1284 bp, Arabidopsis thaliana; identical to SEQ ID NO: 1389
  G986 DNA sequence used for BLAST

SEQ ID NO: 1391 - DNA, 4011 bp, Arabidopsis thaliana
  G987 cDNA Sequence
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 1392 - protein, 1336 aa, Arabidopsis thaliana
  G987 Amino Acid Sequence
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKGRIVYGSSIWVPFFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPA

SEQ ID NO: 1393 - DNA, 4951 bp, Arabidopsis thaliana
  G987 Genomic Sequence
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttgtagacagtttgttctcttgcatcccaaggaatgattttatatagggtttttctgttgatagtttcattgttcaggtttcttgtcttcttgacggggtttctaagttagggttactacttaggcatgatgccatgatctaaaaaaaaaaaactattttactttcaacattttaactttttaatgtttatggaaaatgttggataatggttacactacgttaccatttggataatttaccatttggtaaattactctatgttacttagttgcaacatgtaacgtaagtagcaaaagcatagataagtgaatttttgttttataactattttgttgaataacatatcgttgaaaaaattgtttcgtgtatctttatgaacatttttcttaatttttcccttaacaaaatttatggattttttccaaatggtaaattgtttagaaaaatgaattattccaccatagtattcctaaaaattacttcaattttaagattaagacccccaaaaagttttgaccttctggatcaaagaattgggccaaagcccaaactaaatttacagagatgaaataagtcaaccaaagtaccgaaccgtcactaatttctgtttgacttctggggacgagtctctctctggaccacttcttcgttcttgtaaaaaaaaactcatttggtacttttttcttagaaagctgtcctaaaagcttaaacactaaaacacatctgtaataataacccaaagatcataacttttaaacctcgtacatcatcagattcattcaaactgaggtaagctatgacatcaatctcccgtatttcccgtgtttactctcattcacatgtgcaattcaatttcggttgcttctggaatctaaagtttgaatttttaattcttcctttgactctctctgtttcgtgttcttcttcttctttttgtgtagctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 1394 - DNA, 4951 bp, Arabidopsis thaliana; identical to SEQ ID NO: 1393
  G987 DNA sequence used for BLAST

SEQ ID NO: 1395 - DNA, 1095 bp, Arabidopsis thaliana; identical to SEQ ID NO: 95
  G994 cDNA Sequence

SEQ ID NO: 1396 - protein, 245 aa, Arabidopsis thaliana
  G994 Amino Acid Sequence
MGGRKPCCDEVGLRKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRKLIRMGIDPNTHRRFDQQKVNEEETILVNDPKPLSETEVSVALKNDTSAVLSGNLNQLADVDGDDQPWSFLMENDEGGGGDAAGELTMLLSGDITSSCSSSSSLWMKYGEFGYEDLELGCFDV

SEQ ID NO: 1397 - DNA, 902 bp, Arabidopsis thaliana
  G994 Genomic Sequence
ctaaacatcgaaacatccaagttctaaatcttcgtatccgaattctccatacttcatccacaaagatgacgaagaagaacatgatgacgtaatgtcaccggacaatagcatcgtaagctctccggcggcgtcgccacctcctccttcgtcattttccattagaaagctccacggctgatcatcaccgtccacgtcagccaattggtttagatttcctgataacactgctgacgtgtcattcttcaaagcaacagatacctcggtctcagacagaggctttggatcgttgaccaatatcgtttcctcctcgttgactttttgttggtcaaatcgacgatgtgtgtttggatcaatacccattcttataagcttcctctttatatgagtgttccaataatttttgatatcgttgtctgttcttcctggtaactccactgcaatcttcgaccatctataaccaaattatatataatgcattagaatattttcaacattagaaatagaaatcatcaaatctaacatattggtttaactaggagggtcataattgtcaaagtagtgtaatagctcgtttttatataatgaaattggtaacaaaattgaaaatataaaaacctattgccaaggcgagcatgaagatcaatgactagttggatttcttcttcagtaaaaagacctctcttgagatctggccggagataattagtccaccggagacggcaacttttgccacacctccttagccccgccagttttggcacgtctctccagcaccatcctcctccaccaccaccgcagttgccacgtgcccttaagaaatcaactagtttcccatcttcttccactgtccatggaccctttcttaatccaacctcatcacaacatggtttacgaccacccat

SEQ ID NO: 1398 - DNA, 902 bp, Arabidopsis thaliana; identical to SEQ ID NO: 1397
  G994 DNA sequence used for BLAST

SEQ ID NO: 1399 - DNA, 1082 bp, Arabidopsis thaliana; identical to SEQ ID NO: 71
  G996 cDNA Sequence

SEQ ID NO: 1400 - protein, 336 aa, Arabidopsis thaliana
  G996 Amino Acid Sequence
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 1401 - DNA, 1194 bp, Arabidopsis thaliana
  G996 Genomic Sequence
atgggaagacattcatgttgttacaaacagaaactgaggaaaggactttggtctcctgaagaagatgagaagcttcttcgttacatcactaagtatggtcatggttgctggagctctgtccctaaacaagctggtacgtttttatttatccaaattcatcttttgtttggttaattatagattcttgaatttgaaaattttgtttaaatcttttgtataggtttacagagatgtggaaaaagttgtagattaagatggataaattatttaagaccagatttgaagagaggagcattttctcaagatgaagaaaatctcattattgaacttcatgccgttcttggcaataggtaaagaacttcgtaccgttctttttcatatatgtttgaatatagtatatatatatatataattgttgttttggtttggtttggtttggttctcagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagctccagcctcagcaacatgcatatggccatatataa

SEQ ID NO: 1402 - DNA, 1194 bp, Arabidopsis thaliana; identical to SEQ ID NO: 1401
  G996 DNA sequence used for BLAST

SEQ ID NO: 1403 - DNA, 513 bp, Arabidopsis thaliana
  G997 cDNA Sequence
tcgacccacgcgtccgatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgtttttttttttaatttctgtttggttttcagatatataataatctctctcaatatccatcctattctaatccaatcaatttaagttcatataaaaaaaaaaaa

SEQ ID NO: 1404 - protein, 77 aa, Arabidopsis thaliana
  G997 Amino Acid Sequence
MASSSMSTSSWTAREDKQFEMALAKFDKDTPDRWQKIARAVGGKSTEEVKRHYELLLRDVNDIESGRYPQPRYRNTN

SEQ ID NO: 1405 - DNA, 234 bp, Arabidopsis thaliana
  G997 Genomic Sequence
tcaattagtgttacggtacctaggttgtggatagcgtcctgactcaatgtcattcacatccctaaggagcaattcatagtgtcgctttacttcttcagttgatttcccaccaactgcccttgcaattttttgccaacggtcaggagtgtccttgtcgaatttcgccaacgccatttcgaattgcttgtcctctctagctgtccatgatgaggtgctcattgaactagaagccat

SEQ ID NO: 1406 - DNA, 234 bp, Arabidopsis thaliana; identical to SEQ ID NO: 1405
  G997 DNA sequence used for BLAST

SEQ ID NO: 1407 - DNA, 1027 bp, Arabidopsis thaliana
  G998 cDNA Sequence
gaaaacataaacatagaagagcaaattaagcaacagtcttacacagacagaagttgtagaattgatttgtgagtgaaaaactatttaagactgaacaagtatgcttgattggggagttcaaggtcatcatcaaaagcatgatcatgatatttatcaacaacaacatcaacaacaaggatgtaggaagggaccatggacacttgaagaagacaagcttctcgcagagtatgttacttcgcatggtgaaggaagatggagcactgtagctaagtgtgcagggttgaatagaagtggtaaaagctgtagactaaggtgggtgaactacttgaggccagggcttaagagaggacaaatcactcctcaagaagaaggaatcatccttgaacttcattccctttggggtaacaagtggtctacaatcgcaagatatttaccaggacgaaccgataatgaaataaaaaactactggagaacacattacaagaaaaaccaaaaatcttcttcgaagcaagacaaagtaaaaaaatctctatcccggaaacaacaacaagtggatcttaaaccacaaccacaagcacaatctgagaatcatcagtctcagctagtgtcccaagatcacatgaatatcgacaacgatcataacatagcttcatccttgtattacccgacaagtgtcttcgatgacaaattatatatgcctcaaagtgtagcaacaacctcatccgaccactctatgatcgatgaaggtcacttgtggggcagcttgtggaatctagacgaggatgatccgcatagctttggtggtggctcaggacagggaacagctgcggatattgatgagaagtttccagacagcggaattgaggccccgtcgtgtggctcaggggattatagttatactggagtttacatgggaggctatattttttgattagtatgctcgaagatatcaagaagttgtgtcttcgtaggttgagaaaaaaattaaaacacaacattgtgaatttataactttagtagtgatcta

SEQ ID NO: 1408 - protein, 276 aa, Arabidopsis thaliana
  G998 Amino Acid Sequence
MLDWGVQGHHQKHDHDIYQQQHQQQGCRKGPWTLEEDKLLAEYVTSHGEGRWSTVAKCAGLNRSGKSCRLRWVNYLRPGLKRGQITPQEEGIILELHSLWGNKWSTIARYLPGRTDNEIKNYWRTHYKKNQKSSSKQDKVKKSLSRKQQQVDLKPQPQAQSENHQSQLVSQDHMNIDNDHNIASSLYYPTSVFDDKLYMPQSVATTSSDHSMIDEGHLWGSLWNLDEDDPHSFGGGSGQGTAADIDEKFPDSGIEAPSCGSGDYSYTGVYMGGYIF

SEQ ID NO: 1409 - DNA, 1747 bp, Arabidopsis thaliana
  G998 Genomic Sequence
atgcttgattggggagttcaaggtcatcatcaaaagcatgatcatgatatttatcaacaacaacatcaacaacaaggatgtaggaagggaccatggacacttgaagaagacaagcttctcgcagagtatgttacttcgcatggtgaaggaagatggagcactgtagctaagtgtgcaggtaactattttgattcaatcatggcttctaaaaacacataagttttactaatctaatctttataatctcgtagacatattagtaagcgaatcaccaaattataccaaagatcttgatcttctttctgtttgagtctttttttcaatgaaagtaagatttaattataatagttatatatacatctatataattaaataacacatgcttttatgacgattaatatagataagtgtgagatcatataagtgtatatggggtatagttgacctgattaagctctttcattctttttctttgtctcttttttatttatttataatctagaagcagtctcaaactttcacaaacagaaagaggacaatgtcatggtggaaaggttttacggtttattgtttttcgaataatcaaaagatgatcttttatgattccttgttttctgttttcaggagttgactttcataagttttgggaacatttttacatatattataccctttttattcgagcattttcgtcgagataatgttaaaatttaagagattcatactcatatattatatagataaagatcatcaagttgcattattttttttatatccatgttatatgtcaaacccatttatagtgctccatttcctttcatggaatttaaaaattagggttgaatagaagtggtaaaagctgtagactaaggtgggtgaactacttgaggccagggcttaagagaggacaaatcactcctcaagaagaaggaatcatccttgaacttcattccctttggggtaacaagtaagctactcttttttttcttcttgatattctctagtaaatggtaagctcaaacctacataatagattgatattatatatcaatgaaagaaagagatacaattactccaaagtttaactaaaatatcatagtctaaactattcttcatgagtctcaactctttattatcatacatttgtactagtgtatacctatgtttagtttttgtaatcaatcctttcatgagaacttacatattttcacaaaatatatataggtggtctacaatcgcaagatatttaccaggacgaaccgataatgaaataaaaaactactggagaacacattacaagaaaaaccaaaaatcttcttcgaagcaagacaaagtaaaaaaatctctatcccggaaacaacaacaagtggatcttaaaccacaaccacaagcacaatctgagaatcatcagtctcagctagtgtcccaagatcacatgaatatcgacaacgatcataacatagcttcatccttgtattacccgacaagtgtcttcgatgacaaattatatatgcctcaaagtgtagcaacaacctcatccgaccactctatgatcgatgaaggtcacttgtggggcagcttgtggaatctagacgaggatgatccgcatagctttggtggtggctcaggacagggaacagctgcggatattgatgagaagtttccagacagcggaattgaggccccgtcgtgtggctcaggggattatagttatactggagtttacatgggaggctatattttttga

SEQ ID NO: 1410 - DNA, 1747 bp, Arabidopsis thaliana; identical to SEQ ID NO: 1409
  G998 DNA sequence used for BLAST

SEQ ID NO: 1411 - protein, 317 aa, Arabidopsis thaliana
  G1000 Amino Acid Sequence
MGRPPCCDKSNVKKGLWTEEEDAKILAYVAIHGVGNWSLIPKKAGLNRCGKSCRLRWTNYLRPDLKHDSFSTQEEELIIECHRAIGSRWSSIARKLPGRTDNDVKNHWNTKLKKKLMKMGIDPVTHKPVSQLLAEFRNISGHGNASFKTEPSNNSILTQSNSAWEMMRNTTTNHESYYTNSPMMFTNSSEYQTTPFHFYSHPNHLLNGTTSSCSSSSSSTSITQPNQVPQTPVTNFYWSDFLLSDPVPQVVGSSATSDLTFTQNEHHFNIEAEYISQNIDSKASGTCHSASSFVDEILDKDQEMLSQFPQLLNDFDY

SEQ ID NO: 1412 - DNA, 1146 bp, Arabidopsis thaliana
  G1000 Genomic Sequence
ctaataatcgaaatcattcaagagttgaggaaactgtgacaacatctcttggtctttatctagtatttcgtcaacgaaggaactcgcggaatgacatgttcccgaggcctttgaatcgatgttttgagagatgtattcggcttcgatgttgaaatgatgttcgttctgcgtaaaagtgaggtcgctagtagctgaggatcccactacttgaggaaccgggtccgagagaaggaaatcgctccagtagaagttagtaaccggtgtttgaggtacttggtttggctgagtgatactagtagaagatgatgaggaagagcatgaagatgtggttccattgagcagatgatttggatggctatagaaatgaaatggagtagtttggtactcagaggaatttgtaaacatcattggagagttggtgtaataactctcatggtttgttgttgtgtttctcatcatttcccaagctgagttggattgtgtgagtatagagttgttagatggttctgttttgaaggatgcatttccatggccgctaatgtttctgaattctgcaaggagttgagaaaccggtttatgagtcaccgggtctatccccattttcatcagcttcttcttcagctttgtgttccagtgattcttcacatcattatccgttcttcctggaagctttcgtgcaatggaagaccacctgaaaacatcagaggttacaattattactaatgagataaaaagtttgatagattcttgtcattgttaaaaagttagttagcaattaggttgcttcattacctgctgccaatggctctatgacactcaatgataagctcttcttcttgggtagagaagctgtcatgtttaaggtcaggtcttaagtaattagtccatcttagtctacagctctttccacatcgattcagacctgcgccgaagaacgaaaaataactcagacttgtttgaaatgagatttcttaagagttaagagaaatgagagagtttttttttggaaaaacctgcttttttggggatcaagctccagtttcctacaccatggatagcaacataagcaaggatcttagcgtcttcttcctcggtccagagacctttcttgacattggacttgtcacaacaaggaggtcttcccat

SEQ ID NO: 1413 - DNA, 1146 bp, Arabidopsis thaliana; identical to SEQ ID NO: 1412
  G1000 DNA sequence used for BLAST

SEQ ID NO: 1414 - DNA, 1059 bp, Arabidopsis thaliana
  G1004 cDNA Sequence
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgatc

SEQ ID NO: 1415 - protein, 300 aa, Arabidopsis thaliana
  G1004 Amino Acid Sequence
MATPNEVSALWFIEKHLLDEASPVATDPWMKHESSSATESSSDSSSIIFGSSSSSFAPIDFSESVCKPEIIDLDTPRSMEFLSIPFEFDSEVSVSDFDFKPSNQNQNQFEPELKSQIRKPPLKISLPAKTEWIQFAAENTKPEVTKPVSEEEKKHYRGVRQRPWGKFAAEIRDPNKRGSRVWLGTFDTAIEAARAYDEAAFRLRGSKAILNFPLEVGKWKPRADEGEKKRKRDDDEKVTVVEKVLKTEQSVDVNGGETFPFVTSNLTELCDWDLTGFLNFPLLSPLSPHPPFGYSQLTVV

SEQ ID NO: 1416 - DNA, 903 bp, Arabidopsis thaliana
  G1004 Genomic Sequence
atggcgactcctaacgaagtatctgcactttggttcatcgagaaacatctactcgacgaggcttctcctgtggctacagatccatggatgaagcacgaatcatcatcagcaacagaatctagctctgactcttcttctatcatcttcggatcatcgtcctcttctttcgccccaattgatttctctgaatccgtatgcaaacctgaaatcatcgatctcgatactcccagatctatggaatttctatcgattccatttgaatttgactcagaagtttctgtttctgatttcgattttaaaccttctaatcaaaatcaaaatcagtttgaaccggagcttaaatctcaaattcgtaaaccgccattgaagatttcgcttccagctaaaacagagtggattcaattcgcagctgaaaacaccaaaccggaagttactaaaccggtttcggaagaagagaagaagcattacagaggagtaagacaaagaccgtgggggaaattcgcggcggagattcgtgacccgaataaacgcggatctcgcgtttggcttgggacgtttgatacagcgattgaagcggctagagcttatgacgaagcagcgtttagactacgaggatcgaaagcgattttgaatttccctcttgaagttgggaagtggaaaccacgcgccgatgaaggtgagaagaaacggaagagagacgatgatgagaaagtgactgtggttgagaaagtgttgaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttga

SEQ ID NO: 1417 - DNA, 903 bp, Arabidopsis thaliana; identical to SEQ ID NO: 1416
  G1004 DNA sequence used for BLAST

SEQ ID NO: 1418 - DNA, 1281 bp, Arabidopsis thaliana
  G1005 cDNA Sequence
gctttttgtgttgaagagagagtttcctatcttctccattcctcccaccatctccctcatcttcatcttcctctctctttctctctttctcaacaatctctattagatctttctccattaccattacctctggctttctcttaaatccaccatcatgaggagaggaagaggctcttccgccgtcgccggacctaccgtcgttgccgccatcaacggatctgtaaaagaaatcagattcagaggcgtaaggaagagaccttggggacgattcgcagctgagatccgtgatccatggaaaaaagctcgtgtttggttaggtactttcgattccgccgaagaagctgctcgcgcttacgactccgccgctcgtaacctccgtggtcctaaagccaaaactaatttccccatcgattcttcttctcctcctcctcctaatctccgatttaatcagattcgtaatcaaaatcaaaaccaagtcgatccgtttatggaccaccggttattcaccgaccatcaacaacagttcccgattgttaaccggcctactagtagcagcatgagcagcaccgttgaatcgtttagcggacccagacctacgacgatgaaaccggccacgacgaagagatatcctagaactccaccggttgttccggaggattgtcacagcgattgcgattcgtcgtcgtctgtaatcgacgacgacgacgatatcgcatcgtcttcacggcgacggaatccgccgtttcaattcgatcttaattttccaccgttggattgtgttgacttgttcaatggcgctgatgatcttcactgtaccgatctacgtctctaatgaattggtaaaatcaaactcaaaatcacagatccgtgatcggtttgattttaatcgaaaacacacaacaaaatccttttttttttttttttaaattttctgtttcgttgatctcatataatttttactatgcgggagaaatagaaagacaaagaaacgaagaagaagaagaagatggtgatgagcttgagagagcttgagctggttctgtgtttcttctgtgatgatattgtaagagtattattattttactattattactaaatcttcaaaaccaagaagaagaagaccgaacacgatgatctgttgtgtctgtttgttttactgtaagaaaaacgcagatctgggtttcgtttttttcttgagatagatcaaacaacccccatctttgtaacatatacatttggaacactcatgattctaaataaaaaatctagaatctttttttc

SEQ ID NO: 1419 - protein, 225 aa, Arabidopsis thaliana
  G1005 Amino Acid Sequence
MRRGRGSSAVAGPTVVAAINGSVKEIRFRGVRKRPWGRFAAEIRDPWKKARVWLGTFDSAEEAARAYDSAARNLRGPKAKTNFPIDSSSPPPPNLRFNQIRNQNQNQVDPFMDHRLFTDHQQQFPIVNRPTSSSMSSTVESFSGPRPTTMKPATTKRYPRTPPVVPEDCHSDCDSSSSVIDDDDDIASSSRRRNPPFQFDLNFPPLDCVDLFNGADDLHCTDLRL

SEQ ID NO: 1420 - DNA, 678 bp, Arabidopsis thaliana
  G1005 Genomic Sequence
atgaggagaggaagaggctcttccgccgtcgccggacctaccgtcgttgccgccatcaacggatctgtaaaagaaatcagattcagaggcgtaaggaagagaccttggggacgattcgcagctgagatccgtgatccatggaaaaaagctcgtgtttggttaggtactttcgattccgccgaagaagctgctcgcgcttacgactccgccgctcgtaacctccgtggtcctaaagccaaaactaatttccccatcgattcttcttctcctcctcctcctaatctccgatttaatcagattcgtaatcaaaatcaaaaccaagtcgatccgtttatggaccaccggttattcaccgaccatcaacaacagttcccgattgttaaccggcctactagtagcagcatgagcagcaccgttgaatcgtttagcggacccagacctacgacgatgaaaccggccacgacgaagagatatcctagaactccaccggttgttccggaggattgtcacagcgattgcgattcgtcgtcgtctgtaatcgacgacgacgacgatatcgcatcgtcttcacggcgacggaatccgccgtttcaattcgatcttaattttccaccgttggattgtgttgacttgttcaatggcgctgatgatcttcactgtaccgatctacgtctctaa

SEQ ID NO: 1421 - DNA, 678 bp, Arabidopsis thaliana; identical to SEQ ID NO: 1420
  G1005 DNA sequence used for BLAST

SEQ ID NO: 1422 - DNA, 913 bp, Arabidopsis thaliana
  G1006 cDNA Sequence
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaaaaaaaaaaaaaaa

SEQ ID NO: 1423 - protein, 243 aa, Arabidopsis thaliana
  G1006 Amino Acid Sequence
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 1424 - DNA, 732 bp, Arabidopsis thaliana
  G1006 Genomic Sequence
atgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataa

SEQ ID NO: 1425 - DNA, 732 bp, Arabidopsis thaliana
  G1006 DNA sequence used for BLAST
ttatgaaaccaataactcatcaacacgtgtctcatcaccaacctcacacttcacctgcaccacctccgacgtcagattctctgcttttctccttcgtttcaacttcccgttttcagacgacgacgtagaagaggacgacgacgacgacgacgaagaagatctcttagacgtgatccgaaccgggtcaggttcaccggaattaaccctcaacggaaaattcaataaagcgcgggaaccacgcatcctaaaagcagctatatcgtaagctaaagccgcatcttccgccgtctcaaacgtccctaaccaaaccctagctccattcttcgccggatcacgtatctccgccgcgaatttcccccacggtctctgcctcactcctctgtaatgcttcgccttcactgccgtctccgtaaccggtatcgctttctttggtttctcctccatcgccgtaaagttctcagttggctcgactttaaccgccggaaaatcaaaaagacagctcaagtccgatgatgacgtgtcaaaatggaaggcatctttgaggagtccgtacaccaacatgtcctctgaatcattctctttcaatggcaaacctccccaactctctgtgaaacacgaactcggtgttgactcattgagtcgcagctcgttctctcctcctcctcctagcaagtgacgtgttatcgactccaacaaagcgtagtcggattctatattgcactgtccgtacat

SEQ ID NO: 1426 - DNA, 1354 bp, Arabidopsis thaliana
  G1008 cDNA Sequence
gcctttttgactcttctttctctcttctactttttttcaggctctctctctatatctctatcttcttctccggttaactaaaagagaaatgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaatttgatgagttcttccccagaatttttctgggtttctctttttggttgtgtgagtgagatgagtggtttgatgacaacgacggggatgaatcttagccgtccgttttccatttcgtggacggctccgatcagcggaagaagcgcaacggagtttttatttatctgtttgagaattttataatttaatttgcgagtaaatatagtaattagtgttaagattgtgagagtttaagttaattagggaggggttttgaatattggggattttgggaggtttttgtttggtttctctccaagtctgtcactatgcaaggaagcagtataaagaccgtatatatattttattattaatattgataaaagtaaaaaaaaaaaaaaaaa

SEQ ID NO: 1427 - protein, 294 aa, Arabidopsis thaliana
  G1008 Amino Acid Sequence
MKSRVRKSKYTVHRKITSTPFDGFPKIVKIIVTDPCATDSSSDEENDNKSVAPRVKRYVDEIRFCDEDDEPKPARKAKKKSPAAAAENGGDLVKSVVKYRGVRQRPWGKFAAEIRDPSSRTRLWLGTFATAEEAAIGYDRAAIRIKGHNAQTNFLTPPPSPTTEVLPETPVIDLETVSGCDSARESQISLCSPTSVLRFSHNDETEYRTEPTEEQNPFFLPDLFRSGDYFWDSEITPDPLFLDEFHQSLLPNINNNNTVCDKDTNLSDSFPLGVIGDFSSWDVDEFFQDHLLDK

SEQ ID NO: 1428 - DNA, 885 bp, Arabidopsis thaliana
  G1008 Genomic Sequence
atgaaaagccgagtgagaaaatccaagtacacggttcaccggaaaatcacatccacaccgttcgacggtttcccgaagattgtcaaaatcatagtcactgacccatgcgctactgattcttccagcgatgaggaaaacgacaacaaatctgttgctccgagggtgaaacgttatgtggatgagatcaggttctgtgacgaagatgacgaacctaaaccggcgaggaaagcgaagaaaaagtccccggcggctgcggcggagaacggtggagatttggtaaagtctgtggtgaagtatagaggagtgagacaacgaccttggggaaaatttgcggcggagattcgtgatccttcgagtcgtactagactctggcttgggacttttgcgacggcggaggaagctgctataggttacgatagagccgcgattcgaatcaaaggtcataacgctcagacgaattttctcactcctcctcctagtccgacgactgaggtgttaccggaaactccggtgattgaccttgaaactgtctctggttgtgattcggcgagggaatcgcaaatcagtctgtgttctccgacttctgttctccggtttagtcacaacgacgaaacagagtacagaacagagccaacggaagaacaaaatccgtttttcttgcctgatttgtttcgctccggagattatttttgggattccgaaattacccctgaccctttgtttctcgacgaattccaccagtccttgttaccaaacatcaacaacaacaacacagtgtgtgataaggatacgaatctgtctgatagttttccgttgggagtgatcggagatttcagctcatgggatgttgatgagtttttccaagatcatttgttggataagtaa

SEQ ID NO: 1429 - DNA, 885 bp, Arabidopsis thaliana
  G1008 DNA sequence used for BLAST
ttacttatccaacaaatgatcttggaaaaactcatcaacatcccatgagctgaaatctccgatcactcccaacggaaaactatcagacagattcgtatccttatcacacactgtgttgttgttgttgatgtttggtaacaaggactggtggaattcgtcgagaaacaaagggtcaggggtaatttcggaatcccaaaaataatctccggagcgaaacaaatcaggcaagaaaaacggattttgttcttccgttggctctgttctgtactctgtttcgtcgttgtgactaaaccggagaacagaagtcggagaacacagactgatttgcgattccctcgccgaatcacaaccagagacagtttcaaggtcaatcaccggagtttccggtaacacctcagtcgtcggactaggaggaggagtgagaaaattcgtctgagcgttatgacctttgattcgaatcgcggctctatcgtaacctatagcagcttcctccgccgtcgcaaaagtcccaagccagagtctagtacgactcgaaggatcacgaatctccgccgcaaattttccccaaggtcgttgtctcactcctctatacttcaccacagactttaccaaatctccaccgttctccgccgcagccgccggggactttttcttcgctttcctcgccggtttaggttcgtcatcttcgtcacagaacctgatctcatccacataacgtttcaccctcggagcaacagatttgttgtcgttttcctcatcgctggaagaatcagtagcgcatgggtcagtgactatgattttgacaatcttcgggaaaccgtcgaacggtgtggatgtgattttccggtgaaccgtgtacttggattttctcactcggcttttcat

SEQ ID NO: 1430 - DNA, 2082 bp, Arabidopsis thaliana
  G1017 cDNA Sequence
atggagcaagagaaaagcttggatccacaactatggcatgcttgtgcaggatcaatggttcaaatcccttcactgaattcaacggttttttacttcgctcaaggccacacagagcacgctcacgcgcctcctgattttcacgcgccgcgcgttccacctcttatcctctgtcgtgtcgtctccgtgaagttcctcgccgacgctgaaacagacgaagtttttgctaaaattacgcttttgccacttccgggaaacgacttggatctagaaaacgacgccgttttgggtctaactcctccttcttctgacggtaacggtaacggtaaagagaaaccggcgtctttcgctaaaacgttaacgcagtctgacgctaataacggcggtggtttctccgttccacgttattgcgccgagacgattttcccgcggcttgattactcggcggagccaccggttcaaaccgtgattgctaaagacatccacggcgagacttggaaattccggcatatttacagaggaacacctcgccgtcatctcctaaccaccggttggagcactttcgttaaccagaagaaactaatcgccggagactcaatcgtcttcctccgttctgaatccggtgacctctgcgtcggaatccgccgcgctaaacgcggcggtctcggatctaacgcaggatccgacaatccttaccctggattctccggtttcctccgtgacgacgagtcaacaacaacaacatcgaagctaatgatgatgaaacgcaacggaaacaacgacggaaacgccgcggctacagggagggttagagtagaagcagtagcggaagcggtggcgcgtgcagcgtgtggacaagcgtttgaggttgtttattatccacgcgctagtacaccggagttttgcgtaaaagcagctgatgttagatcagcaatgaggataagatggtgtagtggtatgcgttttaaaatggcgtttgaaacagaggattcttctagaatcagttggtttatgggtactgtctccgccgttcaagtcgctgatccaattcgttggcctaattcaccatggcgtctccttcaggtagcttgggacgaaccggatttgttacaaaacgttaagcgggttagtccgtggttagtcgaattggtatcgaacatgcctacaatacatttatctccattctctccgaggaagaagattaggattccgcagccatttgagtttccattccacggtactaaattcccgattttctccccgggattcgccaacaatggcggtggcgagtccatgtgttatctgtcaaacgacaacaataatgctcctgcaggaatacagggagccaggcaagctcaacaactcttcggatcaccatctccgtctttgttgtctgatctcaatcttagtagttacaccggtaacaacaagttacattctccggcgatgtttctatcgagtttcaacccgaggcatcatcattatcaggctagggatagtgagaatagtaataacatttcgtgttctttaactatggggaatcctgctatggttcaggataagaagaagtctgttggttcggttaagactcatcagttcgtgttgttcggtcaaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttcatggaatctgaggatgttggacgcacactcgatctctcggttattggctcgtaccaagaattgtaccggaaattggctgagatgtttcatatagaagagaggtcggatttgttgactcatgttgtgtaccgggatgcaaatggtgttatcaaacgtattggagacgaacctttcagtgatttcatgaaagcaactaaacggctaacaatcaagatggatattggtggcgacaacgtgagaaagacgtggataaccggaatcaggactggtgaaaatggtatagacgcttctacgaagactggtccgctcagcatcttcgcttga

SEQ ID NO: 1431 - protein, 693 aa, Arabidopsis thaliana
  G1017 Amino Acid Sequence
MEQEKSLDPQLWHACAGSMVQIPSLNSTVFYFAQGHTEHAHAPPDFHAPRVPPLILCRVVSVKFLADAETDEVFAKITLLPLPGNDLDLENDAVLGLTPPSSDGNGNGKEKPASFAKTLTQSDANNGGGFSVPRYCAETIFPRLDYSAEPPVQTVIAKDIHGETWKFRHIYRGTPRRHLLTTGWSTFVNQKKLIAGDSIVFLRSESGDLCVGIRRAKRGGLGSNAGSDNPYPGFSGFLRDDESTTTTSKLMMMKRNGNNDGNAAATGRVRVEAVAEAVARAACGQAFEVVYYPRASTPEFCVKAADVRSAMRIRWCSGMRFKMAFETEDSSRISWFMGTVSAVQVADPIRWPNSPWRLLQVAWDEPDLLQNVKRVSPWLVELVSNMPTIHLSPFSPRKKIRIPQPFEFPFHGTKFPIFSPGFANNGGGESMCYLSNDNNNAPAGIQGARQAQQLFGSPSPSLLSDLNLSSYTGNNKLHSPAMFLSSFNPRHHHYQARDSENSNNISCSLTMGNPAMVQDKKKSVGSVKTHQFVLFGQPILTEQQVMNRKRFLEEEAEAEEEKGLVARGLTWNYSLQGLETGHCKVFMESEDVGRTLDLSVIGSYQELYRKLAEMFHIEERSDLLTHVVYRDANGVIKRIGDEPFSDFMKATKRLTIKMDIGGDNVRKTWITGIRTGENGIDASTKTGPLSIFA

SEQ ID NO: 1432 - DNA, 2335 bp, Arabidopsis thaliana
  G1017 Genomic Sequence
tcaagcgaagatgctgagcggaccagtcttcgtagaagcgtctataccattttcaccagtcctgattccggttatccacgtcctatgcaaacccgaaaaaagcaaactaaactcggtattccaatcggtatataatcaaacccgaaatgtgagcttgagatagacttactttctcacgttgtcgccaccaatatccatcttgattgttagccgtttagttgctttcatgaaatcactgcatttttaaaccggttaatcaatcaaatgacgataatcgcaaacaaacggttaattgaaagaattcttttgagatttttacctgaaaggttcgtctccaatacgtttgataacaccatttgcatcccggtacacaacatgagtcaacaaatccgacctctcttctatatgaaacatctcagccaatttccggtacaattcttggtacgagccaataaccgagagatcgagtgtgcgtccaacatcctcagattccatgaaaactttacaatgacccgtctcaagtccttgcaaactataattccatgttaacccacgagccactaaacctttctcctcctccgcttccgcctcttcttccaaaaaccgttttcggttcataacttgctgttcggttaaaatcggttgaccgaacaacacgaactgatgagtcttaaccgaaccaacagacttcttcttatcctgaaccatagcaggattccccatagttaaagaacacgaaatgttattactattctcactatccctagcctgataatgatgatgcctcgggttgaaactcgatagaaacatcgccggagaatgtaacttgttgttaccggtgtaactactaagattgagatcagacaacaaagacggagatggtgatccgaagagttgttgagcttgcctggctccctgtattcctgcaggagcattattgttgtcgtttgacagataacacatggactcgccaccgccattgttggcgaatcccggggagaaaatcgggaatttagtaccgtggaatggaaactcaaatggctgcggaatcctaatcttcttcctcggagagaatggagataaatgtattgtaggcatgttcgataccaattcgactaaccacggactaacccgcttaacgttttgtaacaaatccggttcgtcccaagctacctataacaaccaatataaccgtaacattaacaaacaaacatggattctgttaaaaggaagagactttgagtaactaactaacctgaaggagacgccatggtgaattaggccaacgaattggatcagcgacttgaacggcggagacagtacccataaaccaactgattctagaagaatcctctgtttcaaacgccattttaaaacgcataccactacaccatcttatcctcattgctgatctaacatcagctgcttttacgcaaaactccggtgtactagcgcgtggataataaacaacctcaaacgcttgtccacacgctgcacgcgccaccgcttccgctactgcttctactctaaccctccctgtagccgcggcgtttccgtcgttgtttccgttgcgtttcatcatcattagcttcgatgttgttgttgttgactcgtcgtcacggaggaaaccggagaatccagggtaaggattgtcggatcctgcgttagatccgagaccgccgcgtttagcgcggcggattccgacgcagaggtcaccggattcagaacggaggaagacgattgagtctccggcgattagtttcttctggttaacgaaagtgctccaaccggtggttaggagatgacggcgaggtgttcctctgtaaatatgccggaatttccaagtctcgccgtggatgtctttagcaatcacggtttgaaccggtggctccgccgagtaatcaagccgcgggaaaatcgtctcggcgcaataacgtggaacggagaaaccaccgccgttattagcgtcagactgcgttaacgttttagcgaaagacgccggtttctctttaccgttaccgttaccgtcagaagaaggaggagttagacccaaaacggcgtcgttttctagatccaagtcgtttcccggaagtggcaaaagcgtaattttagcaaaaacttcgtctgtttcagcgtcggcgaggaacttcacggagacgacacgacagaggataagaggtggaacgcgcggcgcgtgaaaatcaggaggcgcgtgagcgtgctctgtgtggccttgagcgaagtaaaaaaccgttgaattcagtgaagggatttgaaccattgatcctgcacaagcatgccatagttgtggatccaagcttttctcttgctccat

SEQ ID NO: 1433 - DNA, 2335 bp, Arabidopsis thaliana; identical to SEQ ID NO: 1432
  G1017 DNA sequence used for BLAST

SEQ ID NO: 1434 - DNA, 813 bp, Arabidopsis thaliana
  G1020 cDNA Sequence
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 1435 - protein, 185 aa, Arabidopsis thaliana
  G1020 Amino Acid Sequence
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 1436 - DNA, 558 bp, Arabidopsis thaliana
  G1020 Genomic Sequence
atgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaatag

SEQ ID NO: 1437 - DNA, 558 bp, Arabidopsis thaliana
  G1020 DNA sequence used for BLAST
ctattccgccggaggagctaagttaagatccagatctaacggcggagatatcttcccagctccaccttcgaaatcaacgaccgacgacgtttcagactcgctctggacaccacacgtcgtcatctttggatacgtcgccatgttatagtagtaaaccggatgcacaagcgggatcttacgacgacacgcgccgccgccgcctaagctgagctcgaggtgcggaggtgttataaaccgtgccgccgtgggagagtcgacgacggtgctactctgagtaggactactaccaacgataacaccgaaattggtcttagccttaacaccacgaaagtcacgcgcggctgcgtcgtaagcacgcgccgcctgctgagcggtgtcgaacgtaccgagccagactcgagttttcttaaccggatctcggatctcagcggcgtatcttccccatggacgtttcctaacgcctctgtaacgaatctctttggcagcattactctcatgatgagtcgggttcgttggagcaaccgggtcgggtttcaaacccatggtgatgttgggcat

SEQ ID NO: 1438 - DNA, 1218 bp, Arabidopsis thaliana
  G1021 cDNA Sequence
atggaggaagaaagagaaaacactaactctatctacatagtttccgagctacttgaagaaattttccttggattgcctttgaaatcaatcctcaaattcaaaaccgtctcaaaacaatggagatcaatcctggaatcgaacttgttcgtggagaggcgtagaactcttcaaaagaaccacccgaaaatcctggctgcttataactgcgactactgcacgcggccgggtatcctccctaagtctcagttcgaaggggacgaagagatcgtttatcttcataccgacgccacgcaaccctcgatgacttgcgacggtttagtctgcatcaccgaacctggttggttcaacgttttgaacgtctccaccggacaactccgaagatttctacccggtccagatccaggaccgcaagcaaattggctcttgggattcggtagagacaaagttacgggcaagtataaaatagtgaggatgtgttttcatgattgttatgaatttgggattcttgatattgaatctggcgaatggagcaaactgatgtcacctcctcatataatgcgagtgggaagtaaatcggtgtgtgtgaatggatcaatctactggttacaaattagtgtgagttacataatactggccttggatcttcaccaagaaacgttcaatggtgtctaccacctcccggctacgtgggtcacgcaagatacccaattagtgaaccttgaggaccgtctagccatggccatgacgaccaaagttgggcctgaatggatactagagatctggagcatggatatagaagaaaaaggatggagcaagcgttacacatggagcaaggcttactccataagtttagcccatagagttgttgtatcctggccatggcaaaaaaggtggttcacgccggtatcggtttctaagcaagggaatcttgtcttctatgataatcacaagaggctgttcaaatattattcaggtacagatgagattcgttgtctctcctctaacattaatgttatatcttcttacgttgaaaatttggccccacttccgttaaaaccaagccatacgcatcacgatcttgggaattcgaattccaagttcagcacatccagatgccacttgtttccgacgcgaggttcttggatatccaaagtttttagaaggaatgttttgtttacctctctagtagtagttggttatatatacttacctctctaa

SEQ ID NO: 1439 - protein, 405 aa, Arabidopsis thaliana
  G1021 Amino Acid Sequence
MEEERENTNSIYIVSELLEEIFLGLPLKSILKFKTVSKQWRSILESNLFVERRRTLQKNHPKILAAYNCDYCTRPGILPKSQFEGDEEIVYLHTDATQPSMTCDGLVCITEPGWFNVLNVSTGQLRRFLPGPDPGPQANWLLGFGRDKVTGKYKIVRMCFHDCYEFGILDIESGEWSKLMSPPHIMRVGSKSVCVNGSIYWLQISVSYIILALDLHQETFNGVYHLPATWVTQDTQLVNLEDRLAMAMTTKVGPEWILEIWSMDIEEKGWSKRYTWSKAYSISLAHRVVVSWPWQKRWFTPVSVSKQGNLVFYDNHKRLFKYYSGTDEIRCLSSNINVISSYVENLAPLPLKPSHTHHDLGNSNSKFSTSRCHLFPTRGSWISKVFRRNVLFTSLVVVGYIYLPL

SEQ ID NO: 1440 - DNA, 1485 bp, Arabidopsis thaliana
  G1021 Genomic Sequence
atggaggaagaaagagaaaacactaactctatctacatagtttccgagctacttgaagaaattttccttggattgcctttgaaatcaatcctcaaattcaaaaccgtctcaaaacaatggagatcaatcctggaatcgaacttgttcgtggagaggcgtagaactcttcaaaagaaccacccgaaaatcctggctgcttataactgcgactactgcacgcggccgggtatcctccctaagtctcagttcgaaggggacgaagagatcgtttatcttcataccgacgccacgcaaccctcgatgacttgcgacggtttagtctgcatcaccgaacctggttggttcaacgttttgaacgtctccaccggacaactccgaagatttctacccggtccagatccaggtaaattctaatattatactttctccgtcccataaaaattgattttttagaaaaaaatagaagttttacattggaaatgtaaaacttagaacagttgatttattttaaccttcattaaataattaaataataatataatatactttttaaagtgtgttaaaaaataaaattatcactagacaatatttcttaaaaaaatgtaaaatttctaaaaaagatccatcatggtaaagcgcagtaaaaaaaaaatatttttacaactttcaggaccgcaagcaaattggctcttgggattcggtagagacaaagttacgggcaagtataaaatagtgaggatgtgttttcatgattgttatgaatttgggattcttgatattgaatctggcgaatggagcaaactgatgtcacctcctcatataatgcgagtgggaagtaaatcggtgtgtgtgaatggatcaatctactggttacaaattagtgtgagttacataatactggccttggatcttcaccaagaaacgttcaatggtgtctaccacctcccggctacgtgggtcacgcaagatacccaattagtgaaccttgaggaccgtctagccatggccatgacgaccaaagttgggcctgaatggatactagagatctggagcatggatatagaagaaaaaggatggagcaagcgttacacatggagcaaggcttactccataagtttagcccatagagttgttgtatcctggccatggcaaaaaaggtggttcacgccggtatcggtttctaagcaagggaatcttgtcttctatgataatcacaagaggctgttcaaatattattcaggtacagatgagattcgttgtctctcctctaacattaatgttatatcttcttacgttgaaaatttggccccacttccgttaaaaccaagccatacgcatcacgatcttgggaattcgaattccaagttcagcacatccagatgccacttgtttccgacgcgaggttcttggatatccaaagtttttagaaggaatgttttgtttacctctctagtagtagttggttatatatacttacctctctaa

SEQ ID NO: 1441 - DNA, 1485 bp, Arabidopsis thaliana; identical to SEQ ID NO: 1440
  G1021 DNA sequence used for BLAST

SEQ ID NO: 1442 - DNA, 4529 bp, Arabidopsis thaliana
  G1025 cDNA Sequence
aaagtcagatgtccagcaggcttttgatgcatgtgattctcttcttgagaatacaagcagatttggaaaaaagagtatgattcatgtcatgtcttggttgaggccagaggtaatgacatcagaggctaggtatgggcaagattcaacgtcaaggatattgagtcatcagttgtgacggaagatgaaactttggactctagtaagcagtctagttttgatgctgctgctttttatgaagccataaagccatcaaagacggatgcaatgcttggagatgacatagctgatttgctcccagaacttaggccgtaccaacgacgggcagcttattggatggttcagcgagagagaggcgatccaataacgttgggagacaaggaagacaaccaattcatttcacctttgtctatctccgtgggattccttgactctgctacaaaaatgttcttgaacccattcagtgggaatatctcattgacaccagagtatttttcacctcgaattcagggcggtatccttgctgatgaaatgggattgggaaaaacggtggaactacttgcttgtatcttttctcatcgaaaaccagcggaggatgaaatttctgtgtctaatggttcatcagttactgatgttttgaacgctggcttgagaagattgaaaagagaacgtgttgagtgcatatgtggagctgtcagtgaaagtcacaaatacaaaggagtttgggtacagtgtgacctttgtgatgcttggcagcatgccgactgtgtaggttattcacctaaagggaaaggtaagaaggatagtcaacatattgatgaaaaagcgtctcaaaagaagagcaaaaaggatgcaacggaaattattgtcagagaaggtgaatatatttgccaaatgtgctcagaacttctacaagtcactgcctctcccatctctacgggtgccactcttattgtctgtccagctcctatattaccgcaatggcattccgagattacacgccatacacgcttgggatctctcataacatgtatctatgaaggtgtgaggaacgcctcactttctgaagaacctatgattgacattactgaacttctcaatgcggacattgttttaactacgtatgatgtccttaaagaggacttgacacatgacttcgacaggcatgatggtgaccggcactgtcttagattccagaaaaggtaccctgttattccgactccactcaccagaatattttggtggaggatttgtttggatgaggcccagatggtggagagcaatgcagctgctgcaacagagatggcgttgagattatacaccaaacaccgttggtgtatcaccggaactcctatacaacgcaaacttgatgacttatttggactattgaagtttcttagagcaaatcctttcgatgtttcaagatggtggattgaagttataagagacccatatgagaggcgagacacaaaggccatggaatttacgcataagtttttcaaacaagttatgtggcgttcttcaaaagtccatgtggctgatgagttgcaacttccacctcaagaggaatgcgtctcgtggcttaaattttccgcaattgaagaacacttttacagtagacagcatgacacttgtgtgagttatgctcgtgaagttatagaaactttgaaacgtgatattctcaaaagaggtcatacttcttctgataatcctttagtcactcatgctgaagctgcaaaactgttgaactcgctcttgaaattgcgccaagcttgctgccaccctcaagtaggaagttcaggtttacgctctttgcaacaaagtccaatgaccatggaagaaattttaatggtccttgtgaaaaagacccagagcgagggagaagaagctcttagagtgttaattgttgcattaaatgggattgctgctattgccatgcttaagcaagaattttctgaagctgtgtccttatacaaggaagcattaagtataactgaagaacacgccgaggattttcgtcttgatccattgttaaatattcacattcttcacaatttagctgagatactaccaatggccaaaagctacggtggaaaactttctgcatcaggaaggcctgaaacaaaaatagatgtaaaagatgatgatcatcatcgtgcatcgaagaggcaaaggatcaatgagctcgagagtttaactcatgattcttcagaaactgtacatcagcgggaagctattgctccagacaatggtttaaagaaggatggagagtgtcatgaagaatgcaaaactctggatatagtttgtgacacactgaaggttaagtatttatccgcattcaactcaaagctttctgcagcacagcacgaattcaaaaaatcatacaatcaggtttctgagtcgttgagcaatatggggaaacaacgttcagtttggtggttggatgccctgcaacttactgaacagaataaagacttctctagcgagttgacaaggaagattgaagaggccctccatggaaacttaaacaattcaagctcctccagagagagttctcgatttagaactatacatggcatgaaacttcatctgcagacgtgtatggatatgctggagagatctagaaagaaagtgatagataggattctagaaattgatcagactatggagaaaccaaagttggaggatattgagcgtattagcaactgcaagtattgcaataagaatagtgatggccccccgtgtattcattgcgagctagatgaactattccaggaatatgaggctaggcttttccgtcttaacaaatctcgcaggggagtaatggaaattgcggctgctgaagagacggtacatttgcagaagaagagagatgctcgtaatctttttttatttggtttatcatcaagaagcaaggatctaaatgcatcacgtggtgatgacgaggagccaaccaaaagaaatgctggtgacattgtggttctttcaaaatctccatctgagacggaaatagttcttggagtgataagaaaccattgcaaaactcatttagatagggaaagcaaattggcagctacaaaacatttgcatacccttgaggtgatgcgaaaggaatatgtacatgcaagggtcttagctagggatcaagctcaactcctacgtgcctatgatgagattaacatgtcaacaatgagactacagcttagagaatcggaagatgacacatcgatctatgctttgggccgggacgagttagatgttgctagtgtgctgaacacaaatgacaaatttatggctcaatcctcgttgcttagtataaaagggaaacttcgttatttgaagggtttgatgaaatccaaacagaaacaagaatccgagagtccagatctttcctcaccaatacatgaaacagtcgatgcttcggatcctgctgaacaggaaagcgaaaacctgcttaagagagatgaagcatgcccgatttgtcatgaaattctaaggaatcagaagatggttttccagtgcgggcattccacttgctgtaactgcttttttgctatgactgagcgcaaatcagttcaagaaacgctgcaaaagtgggtgatgtgtccaatatgcaggcagcatacagatgttagaaatattgcatatgctgatgatagaagaaacagttcttcgtcagatcaagatcacaaagacagtgaagcatcattggtggttcaaggttcatatggaacaaagattgaagctgttactagaagaatcttatggatcaagtcaagtgacccacaaacgaaggttcttgttttctccagctggaacgatgttcttgatgtgttggaacatgccttcgctgcaaatagcatcacctgcatccggatgaaagggggcaggaaatcacagacagccattagcaaattcaagggatctgagaaagaaacccaaaagacaaactcccatcaaaaagaggaaaaatcgattcaagtgttattgcttttggtgcagcatggtgccaacggtcttaatcttctagaagcacagcatgttattctggtggagccacttctaaatccagctgcggaagcgcaagctgttgggcgtgttcaccgaattggacaagagaagcctactctagttcatcggtttctggtatcgggcacagtggaagagagcatctacaaactgaacaggaataagaatacaaacttaagttcatttagcagcaggaatacaaagaatcaagatcaacagttcttgacactaaaagatcttgaatctctatttgcttcaccaacagcagaaacagcagagatggaacaaaacccaggagagagacaggagaatctgagagatctaccaccctcagtcgctgcagcattagcagccgagaggagaatgaaggaaagtaatgcatcctcatcaactacaaacgcatcatgactatggaaaaggttgcagagagattggttccagccaaatgtttgttggagcgtcttgttgtatgcacataagatggtgaagagagaagctgctcg

SEQ ID NO: 1443 - protein, 1389 aa, Arabidopsis thaliana
  G1025 Amino Acid Sequence
MLGDDIADLLPELRPYQRRAAYWMVQRERGDPITLGDKEDNQFISPLSISVGFLDSATKMFLNPFSGNISLTPEYFSPRIQGGILADEMGLGKTVELLACIFSHRKPAEDEISVSNGSSVTDVLNAGLRRLKRERVECICGAVSESHKYKGVWVQCDLCDAWQHADCVGYSPKGKGKKDSQHIDEKASQKKSKKDATEIIVREGEYICQMCSELLQVTASPISTGATLIVCPAPILPQWHSEITRHTRLGSLITCIYEGVRNASLSEEPMIDITELLNADIVLTTYDVLKEDLTHDFDRHDGDRHCLRFQKRYPVIPTPLTRIFWWRICLDEAQMVESNAAAATEMALRLYTKHRWCITGTPIQRKLDDLFGLLKFLRANPFDVSRWWIEVIRDPYERRDTKAMEFTHKFFKQVMWRSSKVHVADELQLPPQEECVSWLKFSAIEEHFYSRQHDTCVSYAREVIETLKRDILKRGHTSSDNPLVTHAEAAKLLNSLLKLRQACCHPQVGSSGLRSLQQSPMTMEEILMVLVKKTQSEGEEALRVLIVALNGIAAIAMLKQEFSEAVSLYKEALSITEEHAEDFRLDPLLNIHILHNLAEILPMAKSYGGKLSASGRPETKIDVKDDDHHRASKRQRINELESLTHDSSETVHQREAIAPDNGLKKDGECHEECKTLDIVCDTLKVKYLSAFNSKLSAAQHEFKKSYNQVSESLSNMGKQRSVWWLDALQLTEQNKDFSSELTRKIEEALHGNLNNSSSSRESSRFRTIHGMKLHLQTCMDMLERSRKKVIDRILEIDQTMEKPKLEDIERISNCKYCNKNSDGPPCIHCELDELFQEYEARLFRLNKSRRGVMEIAAAEETVHLQKKRDARNLFLFGLSSRSKDLNASRGDDEEPTKRNAGDIVVLSKSPSETEIVLGVIRNHCKTHLDRESKLAATKHLHTLEVMRKEYVHARVLARDQAQLLRAYDEINMSTMRLQLRESEDDTSIYALGRDELDVASVLNTNDKFMAQSSLLSIKGKLRYLKGLMKSKQKQESESPDLSSPIHETVDASDPAEQESENLLKRDEACPICHEILRNQKMVFQCGHSTCCNCFFAMTERKSVQETLQKWVMCPICRQHTDVRNIAYADDRRNSSSSDQDHKDSEASLVVQGSYGTKIEAVTRRILWIKSSDPQTKVLVFSSWNDVLDVLEHAFAANSITCIRMKGGRKSQTAISKFKGSEKETQKTNSHQKEEKSIQVLLLLVQHGANGLNLLEAQHVILVEPLLNPAAEAQAVGRVHRIGQEKPTLVHRFLVSGTVEESIYKLNRNKNTNLSSFSSRNTKNQDQQFLTLKDLESLFASPTAETAEMEQNPGERQENLRDLPPSVAAALAAERRMKESNASSSTTNAS

SEQ ID NO: 1444 - DNA, 6872 bp, Arabidopsis thaliana
  G1025 DNA sequence used for BLAST
tcatgatgcgtttgtagttgatgaggatgcattactttccttcattctcctctcggctgctaatgctgcagcgactgagggtggtagatctctcagattctcctgtctctctcctgggttttgttccatctctgctgtttctgctgttggtgaagcaaatagagattcaagatcttttagtgtcaagaactgttgatcttgattctttgtattcctgctgctaaatgaacttaagtttgtattcttattcctgttcagtttgtagatgctctcttccactgtgcccgatacctggttccccaaaaaagagaggtcaagatcaaagtgaatcacataaggcaggatcttgaagctgtacaagaccaaggtggcaaacaaagcagatacactaaccagaaaccgatgaactagagtaggcttctcttgtccaattcggtgaacacgcccaacagcttgcgcttccgcagctggatttagaagtggctccaccagaataacatgctgtgcttctagaagattaagaccgttggcaccatgctgcaccaaaagcaataacacttgaatcgatttttcctctttttgatgggagtttgtcttttgggtttctttctcagatcccttgaatttgctaatggctgtctgtgatttcctacatttccataaaataaaagttacatgcatcccttaggctacctatgtgccacttttaacagactccccattaaaattctcactacattacctgccccctttcatccggatgcaggtgatgctatttgcagcgaaggcatgttccaacacatcaagaacatcgttccagctggagaaaacaagaaccttcgtttgtgggtcacttgacttgatccataagattcttctagtaacagcttcaatctacccccaaaacaatagatgagaaaaagaagtacttcttgtgcactgatcttagaagcaaggagactaacctttgttccatatgaaccttgaaccaccaatgatgcttcactgtctttgtgatcttgatctgacgaagaactgtttcttctatcatcagcatatgcaatatttctaacatctgtatgctgcctgcatattggacacatcacccacttttgcagcgtttcttgaactgatttgcgctcagtcatagcaaaaaagcctgtgtgaacaaacacaaagaagcagatatgggtaacattctttaggttcacgaagaatatagtagattaatggaacacaaagaaaatgcttaaaactcgaagctgaaaaacaaacaatcgaaaggtcaaagtaattacagttacagcaagtggaatgcccgcactggaaaaccatcttctgattccttagaatttcatgacaaatcgggcatgcttcatctctcttaagcaggttttcgctttcctgttcagcaggatccgaagcatcgactgtttcatgtattggtgaggaaagatctggactctcggattcttgtttctgtttggatttcatcaaaccctgcaacggaaaaaagatttgttcaatattggatacaaaatcaaagaaagagagggaaagcaagcagatattttccagcgatccaaagtctcacaaaaaggaacttagccacaaagacataactatagcttctcgtgactaaaaaattgaaatgggtagagctctggagctggaattgcaaaacaaatgtgatcaagtgtaactatccacgtaaacttcttaatagtaacacagatataaatgacttataggcatgataaaaataggaggtcaggctaataacacactaaggttacagatttaccttcaaataacgaagtttcccttttatactaagcaacgaggattgagccataaatttgtcatttgtgttcagcacactagcaacatctaactcgtcccggcccaaagcatagatcgatgtgtcatcttccgattctctaagctgtagtctcattgttgacatgttaatctcatcataggcacgtaggagttgagcttgatccctagctaagacccttgcatgtacatattcctttcgcatcaccttaattagataagcaaaattggaaatgtcagatcttgttacaaaaatgaaggaatagttttccctttctcaatgtaagcaaagaagggatctctcaggcaatacctcaagggtatgcaaatgttttgtagctgccaatttgctttccctatctaaatgagttttgcaatggtttcttatcactccaagaactatttccgtctcagatggagattttgaaagctatgataagaacataaaagaaatatttatcagactgcgacgatcattacaaaatcatattatttgacatttcaaaagattttaaacaaaagaggaaatagagaacgccgtatcaataaagttaataaacagagatgtggttaggatttattctcagtaatgaattcaaagacttcttgaagtaataccaaatccaaactagatcaagtaacttacaaccacaatgtcaccagcatttcttttggttggctcctcgtcatcaccacgtgatgcatttagatccttgcttcttgatgataaaccaaataaaaaaagattacgagcatctctcttcttctgcaaatgtaccgtctcttcagcagccgcaatttccattactcccctgcgagatttgttaagacggaaaagcctagcctcatattcctggaatgattttttgatacatgatgatgtgacagctaatattaatatcgatttaagttcatataagtgcagaagcaaaaaagagcaaacctggaatagttcatctagctcgcaatgaatacacggggggccatcactattcttattgcaatacttgcagttgctaatacgctcaatatcctccaactttggtttctccatagtctgatcaatttctagaatcctatctatcactttctttctagatctctccagcatatccatacacgtctgcagatgaagtttcatgccatgtatagttctaaatctggaataaggaatttgcaagttagttcataacgtactcaagttatgtgctcctagaatactgtctgcttacaaatcaggaaacatctgagattagattgaatataatgatctattgctaagactttcactacatatgatactgaaattatagggtaatcaatctagtcttttaatgaagctaaccagtctcttaggtcacttcttctaataactttgcggacacatgtagaaaatatgccccatatcacagacaaatttgtgactaaaagctgagaaagtactctggcaaaaacaaagctcacaaaactgcaaatttttaagcactaaccgagaactctctctggaggagcttgaattgtttaagtttccatggagggcctcttcaatcttccttgtcaactcgctagagaagtctttattctgttcagtaagttgcagggcatccaaccaccaaactgaacgttgtttccccatattgctcaacgactcagaaaccttgaaagtttttcaaccatttagcattgtgtcacagagagcgagctccaggaaaataagtgatgctcaatatttaacatgcctgatcttgaaacttaatttaaacggattatatttacacttaggctaagggtacaagtagctttttgagattaaagaaaaaaagatataaatatttttgtggaaaatacctgattgtatgattttttgaattcgtgctgtgctgcagaaagctttgagttgaatgcggataaatacttaaccttcagtgtgtcacaaactatatccagagttttgcattcttcatgacactctccatccttctttaaaccattgtctggagcaatagcttcccgctgatgtacagtttctgaagaatcatgagttaaactctcgagctcattgatcctttgcctcttcgatgcacgatgatgatcatcatcttttacatctatttttgtttcaggccttcctgatgcagaaagttttccaccgtagcttttggccattggtagtatctcagctaaattgtgaagaatgtgaatatttaacaatggatcaagacgaaaatcctcggcgtgttcttcagttatacttaatgcttccttgtataaggacacagcttcagaaaattcttgcttaagcatggcaatagcagcaatcccatttaatgcaacaattaacactctaagagcttcttctccctcgctctgggtctttttcacaaggacctaagaaaaacttcaattagcacaaataagtaacgaagattaaaacgctaaatcttgcaaaatcaccattaaaatttcttccatggtcattggactttgttgcaaagagcgtaaacctgaacttcctacttgagggtggcagcaagcttggcgcaatttcaagagcgagttcaacagttttgcagcttcagcatgagtgactaaaggattatcagaagaagtatgacctgtagattatcacaagttggatagaaacttaagcagccagtacagaaggaagtgtcaaacttctgagagtgaacttttggaggcaataaaagacaaaagtggaaagtgctgaagacactatgtgcaccccatggtacctcttttgagaatatcacgtttcaaagtttctataacttcacgagcataactcacacaagtgtcatgctgtctactgtaaaagtgttcttcaattgcggaaaatttaagccacgagacgcattcctcttgaggtggaagttgcaactcatcagccacatggacttttgaagaacgccacataacttgtttgaaaaacttatgcgtaaattccatggcctttgtgtctcgcctctgaacaaatcaagaaggttgttagacaagaaaactataaaaggtaagaaatgtttttttttttcctgctcgacctcatatgggtctcttataacttcaatccaccatcttgaaacatcgaaaggatttgctttaagaaacttcaatagtccaaataagtcatcaagtttgcgttgtataggagttccggtgatacaccaacggtgtttggtgtataatctcaacgccatctctgttgcagcagctgcattgctctccaccatctgggcctcatccaaacaaatcctccaccaaaatattctggtgagtggagtcggaataacagggtacctatcacaatatgaaatctttactcaatctctccgaaaagctattcaattgcaggaaaccaggagataaaaaaaaatcctgtcagattaaatttgctgttgttcaatatggctcgtctgagtacatgagtatggaactaatctatattggcaaattcttagaaatattttaataattcatcttcttcaatatatcaggtatgacaaaagttcatcatgtaatgaaaaatgcgaggtataagaatcctaaatataattaatcacaccttttctggaatctaagacagtgccggtcaccatcatgcctgtcgaagtcatgtgtcaagtcctctttaaggacatcatacgtagttaaaacaatgtccgcattgagaagttcagtaatgtcaatcataggttcttcagaaagtgaggcgttcctcacaccttcatagatacatgttatgagagatcccaagcgtgtatggctacaacatgacagatgaaagaaggaaagaggactcacattacatgatgtggagatacacaaaaaattacgtctagtgaaagccatcttgttaagtgttcctctagtcaaaacataacagaagggagagaagaatctcataccgtgtaatctcggaatgccattgcggtaatataggagctggacagacaataagagtggcacccgtagagatgggagaggcagtgacttgtagaagttcagagcacatttggcaaatatattcaccttctctgacaataatttccgttgcatcctttttgctcttcttttgagatgctttttcatcaatatgttgactatccttcttacctttccctttaggtgaataacctacacagtcggcatgctgccaagcatcacaaaggtcacactgtacccaaactcctttgtatttgtgactttcactgacagctccacatatgcactcaacacgttctcttttcaatcttctcaagccagcgttcaaaacatcagtaactgatgaaccattagacacagaaatttcatcctccgctggttttcgatgagaaaagatacaagcaagtagttccaccgtttttcccaatcccatttcatctgcagcattcgtactttaccacattaagaacgaaacgcatgagaaatattagaggtagacaaagccatatacaccatctagcatttaagacgacttaaaacatatatttctgaaaatattctttgtgaaagcaagtcaaaacaaaattatccttgtaaataattttctgattatatagtacatggaggcaaaatgaagccgcaaattgttcataccagcaaggataccgccctgaattcgaggtgaaaaatactctggtgtcaatgagatattcccactaaaaacaaccaaaacatgacaaattgaccagaacaaattagttcttctgtaaatggcggaacttcactgagcagaacatacactatttgttgacgatgagaggagcttatagttcaaaataaaattaaaaaggactacttagattcttttctactaacctgaatgggttcaagaacatttttgtagcagagtcaaggaatcccacggagatagacaaaggtgaaatgaattggttgtcttccttgtctcccaacgttattggatcgcctctctctcgctgaaccatccaataagctgcccgtcgttggtacggcctaagttctgggagcaaatcagctatgtcatctccaagcat

SEQ ID NO: 1445 - DNA, 885 bp, Arabidopsis thaliana
  G1030 cDNA Sequence
cgaaaaatattcacagatattttcgatcttaaccgagaaaaaggaagaaatggctggaccatcgacaacttcaaacgcaccaaagcagaggaagagagtcgaagccgagactagcagcaacacttctactaccttacgtcgcgctaaagacggaagcgctttcgctctctgtgaaggatgtaacaagagtgtagctgtagcgcttataagcatgcacaattgcagtctcgatgctaagatcagagtgaatctcgaagcacaagttgtggagacacaagcagaggctaagaagaagcctgcagagaagaagaagacaacatctgatggacctaagccaaagagacttaagaaaaccaatgatgagaagaagagctcgtctacttcaaacaagcccaagcgacctcttaccgctttctttatcttcatgagtgacttccgtaaaacgtttaagtcagagcataatggttcgttagctaaggatgctgcaaagatcggtggtgagaagtggaagtctttgactgaggaagagaagaaagtttatctggataaagctgctgaacttaaggcagagtataacaagtcactggaaagtaatgatgctgatgaggaagaggaagatgaggagaagcaatctgatgatgttgatgatgctgaggagaaacaagttgacgatgatgatgaagttgaggagaaagaagttgagaacacagatgatgacaagaaagaagctgagggtaaagaagaggaggaagaagagattttggatgactactagaaatgatatgctcgtttttgtggttctagtcttactgaaatcggtttatctctaatcgttgcgatgcattgtaaatgaagcctttattagtgaaagtagtttatttgaaa

SEQ ID NO: 1446 - protein, 241 aa, Arabidopsis thaliana
  G1030 Amino Acid Sequence
MAGPSTTSNAPKQRKRVEAETSSNTSTTLRRAKDGSAFALCEGCNKSVAVALISMHNCSLDAKIRVNLEAQVVETQAEAKKKPAEKKKTTSDGPKPKRLKKTNDEKKSSSTSNKPKRPLTAFFIFMSDFRKTFKSEHNGSLAKDAAKIGGEKWKSLTEEEKKVYLDKAAELKAEYNKSLESNDADEEEEDEEKQSDDVDDAEEKQVDDDDEVEEKEVENTDDDKKEAEGKEEEEEEILDDY

SEQ ID NO: 1447 - DNA, 1449 bp, Arabidopsis thaliana
  G1030 DNA sequence used for BLAST
ctagtagtcatccaaaatctcttcttcctcctcttctttaccctcagcttctttcttgtcatcatctgtgttctcaacttctttctcctcaacttcatcatcatcgtcaacttgtttctcctcagcatcatcaacatcatcagattgcttctcctcatcttcctcctgaaaaagtcatcgaatcatctcaacactaaagatttcatttagtaagtgaaacactgcccattaattatgaaacacatacttcctcatcagcatcattactttccagtgacttgttatactctgccttaagttcagcagctttatccagataaactttcttctcctaaatgatcaaagaacacaaaccagagtaagaacacagtaaacaaatcaccatgacactaatgaagaaacacgaaaataaaacaactcacttcctcagtcaaagacttccacttctcaccaccgatctttgcagcctacaatcatatatatacatagcccagattagtaaatctcataaacactaaacatagtactcaaatcatagtaatgagctcggttcaagtcttacatccttagctaacgaaccattatgctctgacttaaacgttttacggaagtcactcctgtaaagtaaaaggttaacatcagcatcaaccctagagactatatcacaatctaaaaaaagcaagtatgaacaaaaaacattacatgaagataaagaaagcggtaagaggtcgcttgggcttgtttgaagtagacgagctcttcttctcatcattggttttcttaagtctctttggcttaggtccatcagatgttgtcttcttcctggaacaaaaacaaacattcaaataattcaatatcacatacagaaactatacaatcaagtcttgacgagtcttacttctctgcaggcttcttcttagcctctgcttgtgtctccacaacttgtgcttctgaacaacaacaacaacaacaaccaaatacacagagactatgagacgatgaaacacacaatacaataagaaggggggaaaaccaaagagatgattaccgagattcactctgatcttagcatcgagactgcaattgtgcatgcttataagcgctacagctacactcttgttacatccttcactgtaatcgattcaatccacagaaaacttatgagaaacccaatcgttaaagctgtaaaaccctaataaatctgaaataaaaacctagatctctaaattcgaaacagaatattccgtcgattcaacagattaagcaagtagaactcaccagagagcgaaagcgcttccgtctttagcgcgacgtaaggtagtagaagtgttgctgctagtctcggcttcgactctcttcctctgctttggtgcgtttgaagttgtcgatggtccagccatttcttcctttttctcggttaagatcgaaaatatctgtgaatatttttcg

SEQ ID NO: 1448 - DNA, 1771 bp, Arabidopsis thaliana
  G1034 cDNA Sequence
ggtgccggtttaattgggttatcggcttttattccctctatcgattatttaatcatcatttttcttcgcgcatcttttgtttagcgcaactgcatgtttttggttatcccttcaacataattgcatattaatttctttcattttaatacctgatacaaaaaagtcgctctaatatataatttattctcaaactttcaatacactccacacagcatggaaactgtacgatatccaaagtacgaaaattcgccggccgagaccatggtggaaagcttcgtgtcgacaccttcttcatttcataaccctccacttttcgacaacaacttaaaccctgtagatgggttttccccacaatcatttgaccgtgactacaatttcaacggtagtttatcagggctgaaccttcccgagaaaaaacccatcaaaaagcgcaagtcttggggacagcaacttcccgaacccaaaacaaaccttcctccgaggaagcgcgcaaagactcaagatgaaaaagagcaacggcgtgttgagcgcgtcctacgcaatcgtagagcggcccaatcatcacgagaacgaaaacgccaggaggtcgaggctttggaagtcgagaaacgagctattgagcgcaaaaacatggatcttgagatgcgcttagcagacatggaagcaaagtactaccttcttcaacaggaactgaaacgagccagtggttacaacaagacaaactttctttcctactctgattcttcaactccagacatctccgaagattcacaattatcacctttgactttctctaagcaactcttcaacgctcaagatgaattgtgtcgaccaataagtcctcagtcaatcggtccgctgacttcaagaaccgttgacccttctacactctcacctaagtctttatcttctcccgattcatccaattctaattcttccgacatgacacaacatcctgccgtggtgttgtgcgacctgcagtgtcagtcggaactgggtcagccttggatgaattcgacatatctttctttgagaacgaaagctctgaaattatcggtaacttaccttattacaatgttaacaacttttttgattgtcctcggaaacctgaatcagaatatcatgtttttaatgacgagatttctcctcacaccaacgtattttattcagaggatgaaaatattcggggacagaacgacggtgttttcgatgaatttgtcgtatgtgatcttctcaacgatgaaactctatcaaacgagagtctgcattcggatcagcttgctgggacgacgacaagcctgcagccgcaatttggcgcgttctctaatgaatgcgacgatggcggcattgcggtttgagtccaaacagcgactttttcgcaattttctctctactgtagcgcttcagatttctcgaagatcctcccactttttatggtactgaaaatactcgaagacactaaactgaacgagagaaatgagaagcgatggttccaatttcaaatgtcgaccttaacttattgtgttcgattgaggattagtaaaaatctaatggtatatttagaataatattcataaagaaaatttataataaatctactcaatacattgaaaaattagcttttggatttttactgcttaggatatagaaatggtcacagttcatagctggttatagacaacgatcatgaaattttaaatgtatctatcctccagtaaggtagtaatcaacgattttgatcgtctaccaccaaaaaaaaaaaaaaaaaaaa

SEQ ID NO: 1449 - protein, 409 aa, Arabidopsis thaliana
  G1034 Amino Acid Sequence
METVRYPKYENSPAETMVESFVSTPSSFHNPPLFDNNLNPVDGFSPQSFDRDYNFNGSLSGLNLPEKKPIKKRKSWGQQLPEPKTNLPPRKRAKTQDEKEQRRVERVLRNRRAAQSSRERKRQEVEALEVEKRAIERKNMDLEMRLADMEAKYYLLQQELKRASGYNKTNFLSYSDSSTPDISEDSQLSPLTFSKQLFNAQDELCRPISPQSIGPLTSRTVDPSTLSPKSLSSPDSSNSNSSDMTQHPAVVLCDLQCQSELGQPWMNSTYLSLRTKALKLSVTYLITMLTTFLIVLGNLNQNIMFLMTRFLLTPTYFIQRMKIFGDRTTVFSMNLSYVIFSTMKLYQTRVCIRISLLGRRQACSRNLARSLMNATMAALRFESKQRLFRNFLSTVALQISRRSSHFLWY

SEQ ID NO: 1450 - DNA, 1771 bp, Arabidopsis thaliana; identical to SEQ ID NO: 1448
  G1034 DNA sequence used for BLAST

SEQ ID NO: 1451 - DNA, 2031 bp, Arabidopsis thaliana; identical to SEQ ID NO: 51
  G1038 cDNA Sequence

SEQ ID NO: 1452 - protein, 444 aa, Arabidopsis thaliana
  G1038 Amino Acid Sequence
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 1453 - DNA, 1912 bp, Arabidopsis thaliana
  G1038 DNA sequence used for BLAST
atggagaaaagcggcttctctcccgtcggtctaagggttcttgtcgtagacgatgatccaacttggctcaagattctcgagaaaatgctcaagaagtgttcttacgaaggtctctttcttcttcttctatcttatgttttccccaacagttggatttactaaaatatctccttactttcctatgttgcagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataagtgagaagaaagatcttgacttgttgtgtaataaatgaaaaaggttattgatttttgtgtgttttgcgttgtagtgatgtcggtggacggcgaaacaagccgagtgatgaagggagtgcaacacggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacagtaagtacgttggcgactttggtttcttatcatgtccccttgcctccctttattatcatgtcttcatagagccgtgaaattttttccggtctcttgtttggcagaagctggtcccaagaagatattggatctcatgaatgttccatggctcactagagaaaatgttgcaagccaccttcaggtaaaaactttaccttgtcatcatcattattcagaacaagtgttagattaagcttttcgtcactttttttttgttctgtttttgtagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgacctcaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaaattctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaggcgattctgagaagcttgaactgggaacttccagaatcacatcattctgtttctttagacactgacttagacttgacttggcttcaaggcgagcgttttcttgcaaacaccggactccagtttcaagattacagtagtagcccatcactcctatctgagctcccagcccaccttaattggtatggaaatgagcggctgcctgaccctgacgagtattccttcatggtagaccaaggtttattcatatcttaa

SEQ ID NO: 1454 - DNA, 1262 bp, Arabidopsis thaliana
  G1039 cDNA Sequence
caagatttatgttttcgtaactgtaactcatagcaaaaacgagtctaagatctgttcataatgatgatgttcaagagcggtgacatggattacacccagaaaatgaagagatgtcacgaatatgtagaagctctagaagaagaacaaaaaaagattcaagtctttcaacgtgagctccctttatgtttagaacttgtaacccaagctatcgagtcatgtcggaaggagttatcggaatcttcagaacatgttggcggccagtcagaatgttctgagcggacaactagtgaatgcggcggtgccgtgtttgaagagtttatgccaatcaagtggagttctgcttcatctgatgaaaccgataaagatgaagaagctgagaaaactgagatgatgaccaatgaaaataacgatggtgataagaagaaatcggattggcttagatctgttcaattgtggaaccaatcaccagatccacaacctaataataagaaaccgatggtaattgaagtcaaacgcagcgctggtgcgtttcaaccgtttcaaaaggagaaacctaaggctgcagattctcaaccacttattaaagcaattactccgacgtcgacgacgacaactagttccacggcggaaaccgtcgggggtggaaaagagtttgaggagcagaaacaatctcattcgaataggaagcaaagacgttgctggtcaccggagttacaccgcagattcttgcacgcgcttcaacaacttggtggatcacatgttgctacgcctaagcagattagagatcttatgaaggtcgatggtttaactaatgacgaagttaaaagtcatttacagaaatatagattgcatacaagaagaccagctactccggtagtaaggaccggtggtgaaaatccacaacaacggcagtttatggtgatggaaggcatttgggtaccttcacacgatacaactaataatagagtttacgctcctgtggcgacacaaccgccgcaatcttcaacgtcgggagagagaagcaatcggggttgcaaatctcccgcaacatcttctactactacacacacaccacaccttcttcctctttcataaatatatagttaccgatttgtatgaaaatttgttttcttctttatatatttgttttgtaaccaagaatgttcgttctaggtttaagagttttgaataaattgtaacaatagatatacattgcacacaattgaataaaagaaaaagttttgataaaaaaaaaaaaaaaa

SEQ ID NO: 1455 - protein, 344 aa, Arabidopsis thaliana
  G1039 Amino Acid Sequence
MMMFKSGDMDYTQKMKRCHEYVEALEEEQKKIQVFQRELPLCLELVTQAIESCRKELSESSEHVGGQSECSERTTSECGGAVFEEFMPIKWSSASSDETDKDEEAEKTEMMTNENNDGDKKKSDWLRSVQLWNQSPDPQPNNKKPMVIEVKRSAGAFQPFQKEKPKAADSQPLIKAITPTSTTTTSSTAETVGGGKEFEEQKQSHSNRKQRRCWSPELHRRFLHALQQLGGSHVATPKQIRDLMKVDGLTNDEVKSHLQKYRLHTRRPATPVVRTGGENPQQRQFMVMEGIWVPSHDTTNNRVYAPVATQPPQSSTSGERSNRGCKSPATSSTTTHTPHLLPLS

SEQ ID NO: 1456 - DNA, 1299 bp, Arabidopsis thaliana
  G1039 Genomic Sequence
ttatgaaagaggaagaaggtgtggtgtgtgtgtagtagtagaagatgttgcgggagatttgcaaccccgattgcttctctctcccgacgttgaagattgcggcggttgtgtcgccacaggagcgtaaactctattattagttgtatcgtgtgaaggtacccaaatgccttccatcaccataaactgccgttgttgtggattttcaccaccggtccttactaccggagtagctggtcttcttgtatgcaatctatatttctataaaaatcaagaaagttgataaaaattatagaactatgaatctatgttgtagtgagaacataaaatgattatgttttgttacctgtaaatgacttttaacttcgtcattagttaaaccatcgaccttcataagatctctaatctgcttaggcgtagcaactgcatatttgacaatgaacaaaaattaaatatatacttctcgtaaaattatgattctcaaacaatcaaaggatttaatatatttaccatgtgatccaccaagttgttgaagcgcgtgcaagaatctgcggtgtaactccggtgaccagcaacgtctttgcttcctattcgaatgagattgtttctgctcctcaaactcttttccacccccgacggtttccgccgtggaactagttgtcgtcgtcgacgtcggagtaattgctttaataagtggttgagaatctgcagccttaggtttctccttttgaaacggttgaaacgcaccagcgctgcgtttgacttcaattaccatcggtttcttattattaggttgtggatctggtgattggttccacaattgaacagatctaagccaatccgatttcttcttatcaccatcgttattttcattggtcatcatctcagttttctcagcttcttcatctttatcggtttcatcagatgaagcagaactccacttgattggcataaactcttcaaacacggcaccgccgcattcactagttgtccgctcagaacattctgactggccgccaacatgttctgaagattccgataactccttccgacatgactcgatagctacaagaatgatatgtaaacaattaagaaactggaagcgatcgtgaaaacgaagaatatatatatcaaaagaggatgtgtaataacattaccttgggttacaagttctaaacataaagggagctcacgttgaaagacttgaatctttttttgttcttcttctagagcttctacatattcgtgacatctcttcattttctgggtgtaatccatgtcaccgctcttgaacatcatcat

SEQ ID NO: 1457 - DNA, 1299 bp, Arabidopsis thaliana; identical to SEQ ID NO: 1456
  G1039 DNA sequence used for BLAST

SEQ ID NO: 1458 - DNA, 1057 bp, Arabidopsis thaliana
  G1040 cDNA Sequence
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 1459 - protein, 270 aa, Arabidopsis thaliana
  G1040 Amino Acid Sequence
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 1460 - DNA, 1734 bp, Arabidopsis thaliana
  G1040 Genomic Sequence
ttaaatcactggagggttccgcatattccatcccccaactaggccgccccaatgtgaaatccaaattgagatgaatgttggtatcctctttctcttcattgtcctattttcaaaatattacacattataagtacataagtaaaagtgtaccattgttaccattgtcagcatgcaattaatgagagataagggataaataatgtaccttagtgtgatgagttgttcccaagtgagaatatgcttgtgtagatatgctcctagatacttcctttgtcgatgaccatgaagctctgttcaaattttaataataaaacacattttagaaatctgtttataactcctattgctggacaaaattgttgtatttggacctacttctatattatcatcaattaatgtacatatacaaattaacaaagaaaattcaaatatcttatatttctaattagactaaaaccaaaaacaacccttaacgaatttaatgagagatggaaaagtacattcacataagccctaggagagggtcatattcatcaaatttcacacagaactaaggcaaaaagagattaaatgcaaaattttacaaaaataaatatataaataaaaagtaacctttgggtcttttgcacagatgatgagtttggcgaatttgtgtcagttccttcatcagcttcttcattattattattgtcctctatcctctgctctgcctctttctctacctttccttctcctgtttattcccaagaacaaaaatacaaattttcttttaaaaattaataaataatgaaattttatttacatttatatctaataagaatgtaaaaatcagtgaactagtttgaatgcatacctggtgatcctttatcagtgcatttcactgttctatacatctgcattaacaatcacacattcttgaaaaatcaaaaacaaattaaaggacgaaaaaaaataaaagaaatgtttggctaagttcatttcaactatgcaatcatgcgttagatagtggcccaattatatacatttcatacatatttacatatacctatatatctatctacatttatgtgtttgaattcgtatgagattccattaatttatatataaaaaatgaagaaaaaataatgaacctgcaagtgactcttgacatgagctagggttagatccttcacattcatgagctccaacactgatttaggcgttgctcctgagacaaaccaatacatgacaaatcttaatactttggtttcaaaacgttacactaacataccaatctcgattggttatgtctttcttttaaaattttttttgattagtataggaaaatgtaagaggacaatacatactttcatggccgccaagaagttgaacagcatggacgaagtgagcatgaagagtagaagtccatctcattcttggagcacgaatgcttcgtttaagaccaaccattgatgatgagcttctcttgaaatctcgaccgtagatttgaggttggaacatgtttgagcgcctttgatgatgatggtcaaatcctaagctcaagagaggtttgttgaagaagttgttctcatggctcaggtcactgaggctgcttccagaatcactgcttgtggagctccggtcaccgccgtgaagaggttttccggcgtgatagttaggaagactgatctgaagagacagatctgggactgagtttgaagctctcatactgtttcttgactctaacatcatcat

SEQ ID NO: 1461 - DNA, 1734 bp, Arabidopsis thaliana; identical to SEQ ID NO: 1460
  G1040 DNA sequence used for BLAST

SEQ ID NO: 1462 - DNA, 968 bp, Arabidopsis thaliana
  G1045 cDNA Sequence
aacattttaaggtaatctcaaaaccaaaaagcctatcaatctttgtacttggatgttttgttgttgcaaggattgcagaggaaaccaacgagtttctaactttgattctctaacaggtgttttctttggagatcttgagtttggacctcagaatcaaagatatataaagatgaatgaggaagaagataaagatcaagatcgagtaacgagaggatgtagtcacactcatagctgtaaccctccaggcccagaggatgcttctcactcccacacatgcttccacgctcacactcatctcatcatctctcaggatcagcaagagaatgatcattctgacagtagcaacaagaaacggttatgtggtaatagagaggcagtgaggaagtacagggagaagaagaaggctcgcactgcataccttgaagatgaagtgatgagattgcaatctctgaatgagcaattccttagaaaacttcagagccaagaaatggtggaaactgaattgatcagactccgggctcttctggtagagatgcaggggaaaattgaagttgaactttgtagtttctcgtttcagaaacaatgcaacggttctggttttgtgttcaaagaagatggatgcaacttagcaacaagtaatatgatgtgtgaagcggcaagagtggagtgcgaggagggccaaacacttcatgatcctattcaatcttttgttcctcaaccaccaccattctcacgttaagcgtttacgggctgtggtattgtgtgtatatatatacatatgggtttaattaggggcatagaggtcggattccaatatagttaacatatacacagattggtaacttattctacatatgtctattttaagggtaccaaaacatcttgatgtggaattgattttgaaatgaagaggaggatgattgtagatttgtagttgtatgtatatatgatgataattgtgggcttaa

SEQ ID NO: 1463 - protein, 228 aa, Arabidopsis thaliana
  G1045 Amino Acid Sequence
MFCCCKDCRGNQRVSNFDSLTGVFFGDLEFGPQNQRYIKMNEEEDKDQDRVTRGCSHTHSCNPPGPEDASHSHTCFHAHTHLIISQDQQENDHSDSSNKKRLCGNREAVRKYREKKKARTAYLEDEVMRLQSLNEQFLRKLQSQEMVETELIRLRALLVEMQGKIEVELCSFSFQKQCNGSGFVFKEDGCNLATSNMMCEAARVECEEGQTLHDPIQSFVPQPPPFSR

SEQ ID NO: 1464 - DNA, 1237 bp, Arabidopsis thaliana
  G1045 Genomic Sequence
ttaacgtgagaatggtggtggttgaggaacaaaagattgaataggatcatgaagtgtttggccctcctcgcactccactcttgccgcttcacacatcatattacttgttgctaagttgcatccatctgtgtgattacacgagatccaaaattgtgtcaagattaggtctaggtcacttttgtataaaaatgatggtgatgaatggtttactattagtttacgttttcattattcgaaaatgtgatttttactaagacgataaccaaataaatgaaactagttctttagcgtttcgtattgttcaataaaatttcagtagctcaaatttcattagctatttactagttcttcctcttaatgctaaatttttcatcaacgtatcagattgttgacaaccaatttcaactagtaaaccaaatagtaggagaaatcaccttctttgaacacaaaaccagaaccgttgcattgtttctgaaacgagaaactacaaagttcaacttcaattttcccctgcatctctaccagaagagcccggagtctgatcaattcagtttccaccatttcttggctctgaagttttctaaggaattgctcattcagagattgcaatctcatcacttcatcttcaaggtatgcagtgcgagccttcttcttctccctgtacttcctcactgcctctctattaccacataaccgtttcttgttgctactgtcagaatgatcattctcttgctgatcctgctgcaacataaaaatatgtatctataacaatccattaaaatatcatcagaaacataccatatcttaagggaagagatattattacagagatgatgagatgagtgtgagcgtggaagcatgtgtgggagtgagaagcatcctctgggcctggagggttacagctatgagtgtgactacatcctctcgttactcgatcttgatctttatcttcttcctcattcatctttatatatctttgattctgaggtccaaactcaagatctccaaagaaaacacctgttctgtttgggacatagaattatggtgatattattagggtttttgattaaagtaaagatggtgttgaagaatatgttcttgattaacatagtggatgaataaaacagtagtcaactctttataattttttgacatggcccaagaaagaaaaatcttacagagaatcaaagttagaaactcgttggtttcctctgcaatccttgcaacaacaaaacat

SEQ ID NO: 1465 - DNA, 1237 bp, Arabidopsis thaliana; identical to SEQ ID NO: 1464
  G1045 DNA sequence used for BLAST

SEQ ID NO: 1466 - DNA, 1035 bp, Arabidopsis thaliana
  G1048 cDNA Sequence
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 1467 - protein, 295 aa, Arabidopsis thaliana
  G1048 Amino Acid Sequence
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 1468 - DNA, 1398 bp, Arabidopsis thaliana
  G1048 DNA sequence used for BLAST
tcacgccgcaagggttaagatttggtatttcatcctaggcctcgaacccttacatctccgactaacgccggtataagacggtttgctactactcccgagcccgtttagaaccagcttttctggttctggacgtaggaggcaacactttgtgtgggacatataagggaataggcaaatgaagtttactcccagaagccaaagcagggaacccaacagcagggattccaacaagagcacagcagactcctgcttcgacatcatggtagtattattgccattacccttttgcaaacagtaacgtagagactggttttcagcaacgaagcactcaagcatacgtcctagtctcaagcattctctttcgagatacttactcttcttctctaaatcttgtacatattccttcttcctctctctcgatctaaccgccgcatctctatttcttactctcctgaaccacaatcacatcccaattatcaaacctcagtttcttttcatagcataaaaggctttaacaatcttaagttaaccaaaatacacatacctatgtttgaacataatcagctcatgaatattaacacaagattaacaataattaaaggcaaccaaaatttaaacagtcatttacttaaatgattagttctcaatgttgttatcaaaacaataacacacttatagcaatctaaatgaaacaaaaatcaacatcactcataatcaatcaactcttcaacgtcacacatacataaacataataacatgaacatatcacaagatacgcaagcaaaatttaaacactcgtttctcaaatcttcactgttacacatacgtatctcctagttctcaatgttgttctcaaagcataacacacttttaacaatcttaatgaaaccaaaatcaacacaaacatacaaaatccatccataaaccctaacttttcaaacaagagtaaaattagatataccttcttcgttttttagccacagcatcatcgtctccttcttcgtcatcatcatcatgaatctcgctaccagaatcattagacttcttctcaacaaccaaatccgaattctccttcccggaatcatcagcggcggcgggagaatcgacggttagaactttatcagccgccaaatcaacggagccagaatcgctagttggataatcaacgagtagatccgctatgaaatctgaaaccgattgctgatccaattccacaaaactctcctcttgatgattctcatcgttcatcaattgattctcgatttctccgatccatgaatccggtgaagactgaagaaaatcctccgccggaagagaatcaattacgattgaaggatcgaaatcgaagaagaaatcttcatctccgagtaaatctatgcttccaaattcctccgccat

SEQ ID NO: 1469 - DNA, 1304 bp, Arabidopsis thaliana
  G1052 cDNA Sequence
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 1470 - protein, 329 aa, Arabidopsis thaliana
  G1052 Amino Acid Sequence
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 1471 - DNA, 1790 bp, Arabidopsis thaliana
  G1052 Genomic Sequence
ttagacattgaggagctgttccttctcaacggacggtttgatatcggccggagattgatcggagacattattctccatcttcttgaggctttgttgatgatatacttgtcgaagtctctctatttctctcttcaatgcttcttgatgagctgaaaatattaaaatttacaattatcagtgttgtcaataaacctaaatattcaatgagtactcacatgtttcatgttaacataaatatctatacttatctcatatatatgttcacacatggacagttgttctaacttattaatcatactaaactctattgatcttgtgattcattattactagctagatccatgttataaaataattagctatagatatatataaaccttactaaatctattcaagcaggacaatatatatttcatgtttgtaattttatgaatcatgaagcatgcattgccgcaagtacttccttgtatatagtttatattactaaagaataattattggtcgagcctatatattgtcagtgactattaaatacatggagctagtgaaacttcagacaataatagtaaaaaaaaacaaacaaatttctatagtttgatagtatccctgaaaaatatattcagaagaattttatacaatgttagaaaattgaaaaaaagttcaaaatagaaaattaccgtctttgaaaatcttatcttgtgctaaagctgcgattcgttgcttgatagcactattgtcgacgttgagaagcaatcgctgatgatccaaaaacgcaactcttggcgataacactgacacttcagtcttcattccacaattttaaatgatttgttgatcagtatttaaactttttatttagattgttttacattaataaacatagtatatctttgtgtgtaaattaattacctgcaatgaagtaacgctcctttcaagctctgatatgtattgcaatttcctcacccttgatctctgtgctgattgcctatttgctaaaattctgtagaaaatttcagcaaaaacaaaaattagattttatcgatgtgacactaatttaactattttataaaaacggtgtatcgaattatcagatactattataaactgtacgtgcatgcatgaccttccttggggttttgggaaatagtaaataaaaatgttaattacctttttacccttttagggtcgtgaatacgattaccggagcttccaccggagttttgattcgccgacggaccatcttgtggctccgtcttgcactggctttggacctcgtctgattcgttgtaattgttaccggcggcgttgttttgattggctacattattgtccatgtgatgatcatgatcggacggtggtgcttctttgttgttgtcgtcgtcgctaaggctattatgatcggacggcgtggaggtgttggaggatgaacgcgtgggacccacattgccgttgatgctgtgatgatgatgatgattgtggttattgttgtgtacgtcgtcgttgaacatggacatgaattgctcgtcgtcaaacctatcgaagtggtggtttccgacgccggaggaaggtggttcaaggaaagcaatggagtcgcttatagaacgacggtgagtcccacggcgagtcgctgagaagtcgagaaactcatccatccatgaagggttttgttgttgaggtccagcggttgctgcggctgccgccgttgcggctatggaagggagtttctgggaggagaagtcaggccaatttggcgtcgtcatggttgggattttcggaggaagttgtgccat

SEQ ID NO: 1472 - DNA, 1790 bp, Arabidopsis thaliana; identical to SEQ ID NO: 1471
  G1052 DNA sequence used for BLAST

SEQ ID NO: 1473 - DNA, 2221 bp, Arabidopsis thaliana
  G1055 cDNA Sequence
atgacggaatcaacatccgtggttgctcctccgccggagatacctaatctgaaccctagcatgttttctgagtccgatttgttttctattccgccgctagatcctcttttcctatctgattctgatccgatttcaatggatgcgccaatctccgatctcgacttcttactcgacgatgagaacggagatttcgctgattttgatttctcgtttgataattctgatgatttcttcgatttcgatttatcggagcccgcggtggtgatccctgaggagatcggtaacaatcgttcgaatttggactcatcggaaaacagaagcggcgatggaggtttagaaggaagatctgagtctgttcattcacaggtttcatctcaaggctccaagacttttgtgtccgacaccgttgacgcatcatcctcccctgaatcaagcaatcaccagaaatcttctgttagcaagaggaagaaggaaaatggagactccagtggcgaattaaggagctgcaagtaccaaaagtccgatgataaatcagtcgctacgaacaacgaaggtgatgatgacgacgacaagaggaagttgataaggcagattaggaaccgtgaaagtgctcagctttcgaggttgaggaagaagcaacaaactgaggagcttgaaagaaaagtgaagagtatgaatgctaccattgctgaattgaatggtaagattgcttatgttatggctgagaatgtcgctttaaggcaacaaatggctgttgcttctggtgctcctcctatgaatccttatatggctgccccgcctttaccgtatcaatggatgccgtatccgccgtatcctgttaggggatatggatcacagacacctttggttcccattcctaagttaaatcctaagcctgtctcgagttgtagaccgaagaaggcagagagtaagaagaatgagggtaaaagtaagctcaagaaggttgctagtattagttttattggaattctcttctttgtcttcttgtttggtacattggttccttttatgaatgtaaattttggaggagaacgtggaagctttggcggtttgtctaaatatgatggccaccggtattacgatgaacataaggggagggttttaatggtcggcgatggttctgatgttagaagaaatagtggaatttctgaaggaaatatccattctagtaggattagtcatggtgagagagatagttgtggaggagtagattataatgctcatccgaaagtagaaggacgaccaagttcgttgagcaatgccagtgatcctctctttgcttctctctatgtcccaagaaacgatgggcttgtgaagatcgatgggaacttgataattcactctgttttggcgagcgagaaagcaaggggtttaggaaagaagaatatcactgaaacagtaaaaactaaagaaccggatttgaccattcctggtgcactgtcttctgcattagctgttccgggggtaagaggaaatgcagcaatgcttccgcattcaacagctctctcttctgaagggaaaagacttcaccaatggtttcatgaaggtggctcagggccactaatggattacagcatgtgcaccgaggttttccagtttgatattgctcctggtgctatagtcccgtcatcagtctccagcatttctgcggagcatctccaaaatgtcactacccacggcaagagaatgaagaacaggagaatccttgagggacttcctgtttcacttgtggcgtcagagctcaatatcaccggaacccagccaaacaaagacgctcaaaataagacctttaatggaaacactaacaaacccacatcatcatcctccatggttgtctcagtgttacttgatccaagagaggtcgttgactctgaaaccgacagagtggttcccccaaacccaaaatcactttcccggatctttgtggtggtgcttcttgacagtgtcaagtacgttacctactcatgcgttcttcctcgatcgggtctccatctcgtagccacctgatttgagctactcagatcttgaccttaagtaggcgaacattgacttgtttatacatacagaccttgttgactttttttccctgtgttgtataactcttatgttctaaggttttggattttaattttgagataagcataaagtggaatccttgttttaaaggcatttccaatagctttaggctgataatacatcc

SEQ ID NO: 1474 - protein, 675 aa, Arabidopsis thaliana
  G1055 Amino Acid Sequence
MTESTSVVAPPPEIPNLNPSMFSESDLFSIPPLDPLFLSDSDPISMDAPISDLDFLLDDENGDFADFDFSFDNSDDFFDFDLSEPAVVIPEEIGNNRSNLDSSENRSGDGGLEGRSESVHSQVSSQGSKTFVSDTVDASSSPESSNHQKSSVSKRKKENGDSSGELRSCKYQKSDDKSVATNNEGDDDDDKRKLIRQIRNRESAQLSRLRKKQQTEELERKVKSMNATIAELNGKIAYVMAENVALRQQMAVASGAPPMNPYMAAPPLPYQWMPYPPYPVRGYGSQTPLVPIPKLNPKPVSSCRPKKAESKKNEGKSKLKKVASISFIGILFFVFLFGTLVPFMNVNFGGERGSFGGLSKYDGHRYYDEHKGRVLMVGDGSDVRRNSGISEGNIHSSRISHGERDSCGGVDYNAHPKVEGRPSSLSNASDPLFASLYVPRNDGLVKIDGNLIIHSVLASEKARGLGKKNITETVKTKEPDLTIPGALSSALAVPGVRGNAAMLPHSTALSSEGKRLHQWFHEGGSGPLMDYSMCTEVFQFDIAPGAIVPSSVSSISAEHLQNVTTHGKRMKNRRILEGLPVSLVASELNITGTQPNKDAQNKTFNGNTNKPTSSSSMVVSVLLDPREVVDSETDRVVPPNPKSLSRIFVVVLLDSVKYVTYSCVLPRSGLHLVAT

SEQ ID NO: 1475 - DNA, 2105 bp, Arabidopsis thaliana
  G1055 DNA sequence used for BLAST
tcaggtggctacgagatggagacccgatcgaggaagaacgcatgagtaggtaacgtacttgacactgtcaagaagcaccaccacaaagatccgggaaagtgattttgggtttgggggaaccactctgtcggtttcagagtcaacgacctctcttggatcaagtaacactgagacaaccatggaggatgatgatgtgggtttgttagtgtttccattaaaggtcttattttgagcgtctttgtttggctgggttccggtgatattgagctctgacgccacaagtgaaacaggaagtccctcaaggattctcctgttcttcattctcttgccgtgggtagtgacattttggagatgctccgcagaaatgctggagactgatgacgggactatagcaccaggagcaatatcaaactggaaaacctcggtgcacatgctgtaatccattagtggccctgcaagagaatgcaatgtagagttgaaaatccagatcactccatttagtagaaactacatagagaacaagaattacctgagccaccttcatgaaaccattggtgaagtcttttcccttcagaagagagagctgttgaatgcggaagcattgctgcatttcctcttacccccggaacagctaatgcagaagacagtgcaccaggaatggtcaaatccggttctttagtttttactgtttcagtgatattcttctttcctaaaccccttgctttctcgctcgccaaaacagagtgaattatcaagttcccatcgatcttcacaagcccatcgtttcttgggacatagagagaagcaaagagaggatcactggcattgctcaacgaacttggtcgtccttctactttcggatgagcattataatctactcctccacaactatctctctcaccatgactaatcctactagaatggatatttccttcagaaattccactatttcttctaacatcagaaccatcgccgaccattaaaaccctccccttatgttcatcgtaataccggtggccatcatatttagacaaaccgccaaagcttccacgttctcctccaaaatttacattcataaaaggaaccaatgtaccaaacaagaagacaaagaagagaattccaataaaactaatactagcaaccttcttgagcttacttttaccctcattcttcttactctctgccttcttcggtctacaactcgagacaggcttaggatttaacttaggaatgggaaccaaaggtgtctgtgatccatatcccctaacaggatacggcggatacggcatccattgatacggtaaaggcggggcagccatataaggattcataggaggagcaccagaagcaacagccatttgttgccttaaagcgacattctcagccataacataagcaatcttaccattcaattcagcaatggtagcattcatactcttcacttttctttcaagctcctcagtttgttgcttcttcctcaacctcgaaagctgagcactttcacggttcctaatctgccttatcaacttcctcttgtcgtcgtcatcatcaccttcgttgttcgtagcgactgatttatcatcggacttttggtacttgcagctccttaattcgccactggagtctccattttccttcttcctcttgctaacagaagatttctggtgattgcttgattcaggggaggatgatgcgtcaacggtgtcggacacaaaagtcttggagccttgagatgaaacctgtgaatgaacagactcagatcttccttctaaacctccatcgccgcttctgttttccgatgagtccaaattcgaacgattgttaccgatctcctcagggatcaccaccgcgggctccgataaatcgaaatcgaagaaatcatcagaattatcaaacgagaaatcaaaatcagcgaaatctccgttctcatcgtcgagtaagaagtcgagatcggagattggcgcatccattgaaatcggatcagaatcagataggaaaagaggatctagcggcggaatagaaaacaaatcggactcagaaaacatgctagggttcagattaggtatctccggcggaggagcaaccacggatgttgattccgtcat

SEQ ID NO: 1476 - DNA, 1663 bp, Arabidopsis thaliana
  G1057 cDNA Sequence
tgcaaaattaagctcagagattcacaccgcatctgaaattgtgctcagaggggttccaaatattaccagtcgttaggaagcaatcacgagttgttttaggaattagtgaacgtgataatggctagcaatgagatggaaaaatcgagtaaagagaaggaacctaaaacacctcctccttcttctactgcccctccctcttcacaggaaccttcatcggctgtgagtgctggcatggctactccagattggtctggttttcaggcatattctcctatgccgccgcctcatggttatgtggcatctagtccccaacctcacccttatatgtggggagttcagcatatgatgcctccttatggaactccgcctcatccttatgttgcaatgtatcccccaggtggcatgtacgcacatccttcaatgcctccgggttcttatccctatagcccttatgctatgccttctccaaatggaatgactgaagtttctggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaagtggggagagtgcttctgatggttcaagtgaaggaagtgatgggaactctcaaaatgattcgggatctggactagatggaaaggatgctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggacgatagagaacttaagcgacagagacggaagcagtccaatagggagtctgctcgaagatcaaggttgcgtaaacaggccgaatgtgatgagctggcccaacgcgctgaggtgttgaacgaagaaaacacaaatctcagagcagaaatcaacaagctcaaaagccaatgcgaagagcttaccaccgagaacacctctctcaaggaccaactttcattattccctccacttgaaggcataagcatggacaatgaccaccaagaaccagacaccaatcaaacaggtgccgcagagagaaaggttgattcatacaaagactcaacgtgagaagacatagagcaaaaccaattcctaacacaggtataaaaaagtagcagcagcagcaacaacaacactcggcggttctttgctaacagatggtttgtaggattttaggcatcagagatcgattggttccgaatagtttattgagggttgttggtccagtgtatgtgtgtgtaagttacgaaattagatattgggagaaaaaattccctcgtttaatgttttactttgcctttgctctacttgcagaagcgaatctgaggcaatgtgcttatctgtatcaaaattgttaccctttttattagcttttcctatttat

SEQ ID NO: 1477 - protein, 409 aa, Arabidopsis thaliana
  G1057 Amino Acid Sequence
MASNEMEKSSKEKEPKTPPPSSTAPPSSQEPSSAVSAGMATPDWSGFQAYSPMPPPHGYVASSPQPHPYMWGVQHMMPPYGTPPHPYVAMYPPGGMYAHPSMPPGSYPYSPYAMPSPNGMTEVSGNTTGGTDGDAKQSEVKEKLPIKRSRGSLGSLNMITGKNNEPGKNSGASANGAYSKSGESASDGSSEGSDGNSQNDSGSGLDGKDAEAASENGGSANGPQNGSAGTPILPVSQTVPIMPMTAAGVPGPPTNLNIGMDYWGAPTSAGIPGMHGKVSTPVPGVVAPGSRDGGHSQPWLQDDRELKRQRRKQSNRESARRSRLRKQAECDELAQRAEVLNEENTNLRAEINKLKSQCEELTTENTSLKDQLSLFPPLEGISMDNDHQEPDTNQTGAAERKVDSYKDST

SEQ ID NO: 1478 - DNA, 2746 bp, Arabidopsis thaliana
  G1057 Genomic Sequence
atggctagcaatgagatggaaaaatcgagtaaagagaaggaacctaaaacacctcctccttcttctactgcccctccctcttcacaggtttgtgtttgcccttctctgcttccaattttcttaagaggaccataatgtaaaaagggaaaacaaatcccatgatttaagctattagaagccgaattagaagtgagatactagaaaggaaaataaaaatattctagatttcagctaattgtgattttgtatacctatcagtgatatgctttagttggaatatttctgtgtttgtaggaaccttcatcggctgtgagtgctggcatggctactccagattggtctggttttcaggttaggacagattcctccatctatggatctgcgctctcttttcttgttgcatttgatctttacggctttcttttcgacaggcatattctcctatgccgccgcctcatggttatgtggcatctagtccccaacctcacccttatatgtggggagttcaggtgaactggcttacgctttatcgctttttactgtgatgtctatcggtgttcagagtgctggaaaattgcaacattcttattgacttataacgaattcgttcagctgtctttcatcatatctttgattgattactgaatgagacattaaattttgcagcatatgatgcctccttatggaactccgcctcatccttatgttgcaatgtatcccccaggtggcatgtacgcacatccttcaatgcctccggtactgccaactgtagtagattcaattgcagtgaacataaattaaaatgtagctgttaattatatctttaatatgttccattctgtatcagggttcttatccctatagcccttatgctatgccttctccaaatggaatgactgaagtttctgtgagttagcgtcccatcatacttcattcgttctttctcaaacggtctttgctacctttgcttattgtaggaacataattgagagatgattttatgcagggcaatactacaggcggcactgatggtgatgctaaacaatctgaagtgaaggaaaaattgcccatcaaaagatcaagaggaagcttgggaagtttgaacatgattacaggaaagaacaatgaacctgggaaaaactcaggagcatcagctaatggagcttactccaaaaggcatgtaacacgcttgtttttatccggtctatgtgacgtggcatgtatgcatggttgttatcttggaaatattattatgtttggactaggaccccttttggacttatgctacttcattagataatattcattctattattgctctgagattgtcagaattgtttggttacagtggggagagtgcttctgatggttcaagtgaaggaagtgatgggaactctcaaaatgtaagtttcggatagctatcatcagccttttcatttgaattatatctttgttggtatgcattcattctggcaaccatgttgtgatgaggcgctgtttcatggggaacacctagtttgtttgctaagaatctagcatgaatctgaatttggattgacctattcagatctgtcagtcccttggaatttctcatttaaattttatgagtgttgctaacacttggaatctgcacactggaacacataacctttgcgttccatatgtcgcctcatcaaacgtttttgttggatctttgggctcgaaaagtcttaatgttatttccgtctttctatgggagtgaggagttcttacagtaattatgactgattctgatttgcttgcaattcatgtaggattcgggatctggactagatggaaaggatggttggtttacgatcttttctttttcctttcgttactatcatgcggctaacaccgtgaaagctacttatcagagagttctttattgtttttccattcagctgaagcagcatcagagaatggtggttctgccaatggtccgcaaaatggaagtgctggtacacctattctaccggtgagccagaccgtaccaatcatgccaatgacagctgcaggtgttcctggcccaccaacaaatttaaatattgggatggattactggggtgctccaacttcagctggtatccctggaatgcatgggaaagtatctacaccagttcctggagttgttgctccaggctcgcgagatggtggccattcacaaccctggttacaggtgtgcccacctttcttaggcagatttaaatcgccttttatcctcaaactcagatttgtttgtcttgcaattaggacgatagagaacttaagcgacagagacggaagcagtccaatagggagtctgctcgaagatcaaggttgcgtaaacaggtactaaacatccatttagatcacctctagcacgcccatgtgagcaaattattgacccggtgtttgtgatttaggccgaatgtgatgagctggcccaacgcgctgaggtgttgaacgaagaaaacacaaatctcagagcagaaatcaacaagctcaaaagccaatgcgaagagcttaccaccgagaacacctctctcaaggtaaaaaaaaagtaatctttcaaaattagttttagagccagccaacgaaacagttaccaactttgttcttgcaggaccaactttcattattccctccacttgaaggcataagcatggacaatgaccaccaagaaccagacaccaatcaaacaggtgccgcagagagaaaggttgattcatacaaagactcaacgtga

SEQ ID NO: 1479 - DNA, 2746 bp, Arabidopsis thaliana; identical to SEQ ID NO: 1478
  G1057 DNA sequence used for BLAST

SEQ ID NO: 1480 - DNA, 1421 bp, Arabidopsis thaliana
  G1058 cDNA Sequence
aaaagatttcgggtcgatgaacatggatgaactcctgaagagcatatggactgctgaggaagctcaggccatggccatgacttctgcgccagctgctacagcggtagcgcaacctggtgctggtatcccacccccaggtgggaatctccagaggcaaggttcgttgacgttgcctagaacaattagtcagaagactgttgatgaggtgtggaaatgtttgatcaccaaggatggtaatatggaaggtagcagcggaggcggtggtgagtcgaatgtgcctcctggaaggcaacagactttaggggaaatgacacttgaagaatttctgttccgtgctggggttgtaagagaagataactgtgttcaacagatgggtcaggtcaacggaaacaataacaatgggttttatggtaacagcactgctgctggcggcttaggttttggatttggtcagccaaatcaaaacagcataacattcaatggtactaatgattctatgatcttgaatcagccacctggtttagggctcaaaatgggtggaacaatgcagcagcaacaacaacaacagcagttgcttcagcagcaacaacagcagatgcagcagctgaatcagcctcatccacagcagcggctgcctcaaaccatttttcctaaacaagcaaacgtagcattttctgcgcctgtgaatataaccaacaagggttttgctggggctgcaaataattctatcaacaataataatggattagctagttacggaggaaccggggtcactgttgcagcaacttctccaggaacaagcagcgcagaaaataattctttatcaccagttccgtatgtgcttaatcgaggacgaagaagcaatacaggtctagagaaggttatcgagaggaggcaaaggagaatgatcaagaatcgggaatcagctgctagatcaagagctcgaaagcaggcttatacattggaactggaagccgaaattgaaaagctcaagaaaacgaatcaagaactgcagaaaaaacaggctgaaatggtggaaatgcagaagaatgagctgaaagaaacgtcgaagcgaccgtggggcagcaaaaggcaatgcttgagaaggacattaaccggaccatggtgaaggatgaagcaacaagaacggatgaaccagactcctagcttgggattaatgtaataggatagtgctacctgtacaggagattaagagaaattgagtgaaagatctaggttacagagtaggagagagttttcattatgaataaatgacattttgtgccctgacctttgttagtttaggtttagattatcctctgttattgacttattgtgctttctggttgttagggtttctaaaagacatagttgtttatatatatgtctgactttgtaaaaaaaaaaaaaaaaaaaaaaaa

SEQ ID NO: 1481 - protein, 370 aa, Arabidopsis thaliana
  G1058 Amino Acid Sequence
MNMDELLKSIWTAEEAQAMAMTSAPAATAVAQPGAGIPPPGGNLQRQGSLTLPRTISQKTVDEVWKCLITKDGNMEGSSGGGGESNVPPGRQQTLGEMTLEEFLFRAGVVREDNCVQQMGQVNGNNNNGFYGNSTAAGGLGFGFGQPNQNSITFNGTNDSMILNQPPGLGLKMGGTMQQQQQQQQLLQQQQQQMQQLNQPHPQQRLPQTIFPKQANVAFSAPVNITNKGFAGAANNSINNNNGLASYGGTGVTVAATSPGTSSAENNSLSPVPYVLNRGRRSNTGLEKVIERRQRRMIKNRESAARSRARKQAYTLELEAEIEKLKKTNQELQKKQAEMVEMQKNELKETSKRPWGSKRQCLRRTLTGPW

SEQ ID NO: 1482 - DNA, 1646 bp, Arabidopsis thaliana
  G1058 Genomic Sequence
atgaacatggatgaactcctgaagagcatatggactgctgaggaagctcaggccatggccatgacttctgcgccagctgctacagcggtagcgcaacctggtgctggtatcccacccccaggtgggaatctccagaggcaaggttcgttgacgttgcctagaacaattagtcagaagactgttgatgaggtgtggaaatgtttgatcaccaaggatggtaatatggaaggtagcagcggaggcggtggtgagtcgaatgtgcctcctggaaggcaacagactttaggggaaatgacacttgaagaatttctgttccgtgctggggttgtaagagaagataactgtgttcaacagatgggtcaggtcaacggaaacaataacaatgggttttatggtaacagcactgctgctggcggcttaggttttggatttggtcagccaaatcaaaacagcataacattcaatggtactaatgattctatgatcttgaatcagccacctggtttagggctcaaaatgggtggaacaatgcagcagcaacaacaacaacagcagttgcttcagcagcaacaacagcagatgcagcagctgaatcagcctcatccacagcagcggctgcctcaaaccatttttcctaaacaagcaaacgtagcattttctgcgcctgtgaatataaccaacaagggttttgctggggctgcaaataattctatcaacaataataatggattagctagttacggaggaaccggggtcactgttgcagcaacttctccaggaacaagcagcgcagaaaataattctttatcaccagttccgtatgtgcttaatcgaggacgaagaagcaatacaggtctagagaaggttatcgagaggaggcaaaggagaatgatcaagaatcgggaatcagctgctagatcaagagctcgaaagcaggtgaatataaatctaactaaacttatctagtcccttttgtttggtttgactattatggtcttatattttgcaagactgcattaaacagaaacataaaaccagcaaagatatcttctatcccgaaccacttcttgtattatgaaagatgctttatcttccatgttttttaactatccactaattacaggcttatacattggaactggaagccgaaattgaaaagctcaagaaaacgaatcaagaactgcagaaaaaacaggtttctttctgtttacaacctctctgtgtgttttctgttttcccctatcagacttttagaacttggctctgatcctagcttcccctgtattgcaggctgaaatggtggaaatgcagaagaatgaggtaattgtttaagaacttttcttttcattgagttcattctgaaacccttgaccatacttgattaggaccaacatcagcagcaaaagactaaacttaagttgtagctctgatagtgtatgttggtccttatcaagtatgtccccaactgaagctcaaacctgagatagctttcgaacatttcgtggtcttgcttcgttttgaatagcctttttgattgtgttgttcactagtattcttttcaaaattagcagctgaaagaaacgtcgaagcgaccgtggggcagcaaaaggcaatgcttgagaaggacattaaccggaccatggtga

SEQ ID NO: 1483 - DNA, 1646 bp, Arabidopsis thaliana; identical to SEQ ID NO: 1482
  G1058 DNA sequence used for BLAST

SEQ ID NO: 1484 - DNA, 375 bp, Arabidopsis thaliana
  G1060 cDNA Sequence
agcagatcttgtactctcgatatacatacttattttatatggcttccaactcaatgagctctagcgcttcttggacacgtaacgagaacaaattatttgaaagggcgttggctacatatgaccaggacactcctgaccgttggcgtaacgttgcaagagccgttggcggcaaatcagctgaagaagtaaggcgacactacgagcctcctcattagggatgtcaatgacattgagtcagggcgttatccacatcccaattaccgttcaaatggaaacaaccactgaaagcattaaaggaactccaaaaggctctactgaagtggacatggttccaaaaccattcacaaagcacatctaagcaaagatatctaaatg

SEQ ID NO: 1485 - DNA, 977 bp, Arabidopsis thaliana
  G1060 Genomic Sequence
ttagatgtgctttgtgaatggttttggaaccatgtccacttcagtagagcctgcaagacataaaatccagatgagttaactacttcaaaagactaaaaagatgtagatatcaaaatgaagaaatcagctagataatcttgttacacaaatttagcaattttaataattctgaactttaactataggctaaccaaaagttagtagagaagggggttacgttatactatttatgtttttgttttttgggggcaaaatactatctatgtaagtggagtagtttttgcaatggtaaagacaagaaacatggaacatgctatcagcctatcactatgtgggactttgatttttgtttgctaaaagacatataaaaagatggatggaagcttttcatcttttcaccaggaaatggctttttgcgtctatgactttttatatatatatatagagctaatgggctaatgatcaatttcaagaacttgacaaaactaacttttgaattctctgttactagattgcttttggccccacagttagaagttgggacagttcatagatatgggaaacggtggtgtttactatatcataaagctagattttttttttctctggcctggtgaaacaagaagacacgcataagaaactggagagtgcatgtctattatttatgaatgctttcttatggataattgttgtgatattctgtttaccttttggagttcctttaatgctttcagtggttgtttccatttgaacggtaattgggatgtggataacgccctgactcaatgtcattgacatccctaatgaggaggctcgtagtgtcgccttacttcttcagctgatttgccgccaacggctcttgcaacgttatgccaacggtcaggagtgtcctggtcatatgtagccaacgccctttcaaataatttgttctccttacgtgtccaagaagcgctagagctcattgagttggaagccat

SEQ ID NO: 1486 - DNA, 977 bp, Arabidopsis thaliana; identical to SEQ ID NO: 1485
  G1060 DNA sequence used for BLAST

SEQ ID NO: 1487 - DNA, 1313 bp, Arabidopsis thaliana
  G1061 cDNA Sequence
caaaaaaaagtgtagaagcagaagaaacccatcatcatcatgatgaactcttctcttctaactccttcttcttcatcttcttcccatatccaaactccatcaacaactttcgaccacgaagacttcctcgatcaaatcttttcctcggccccgtggccctccgtcgtcgatgatgctcatcctcttccctccgatggcttccacggccacgatgtcgactcaaggaatcagccgatcatgatgatgcctttgaatgatggctcctccgtccacggtctttataatggcttctccgtcgccggatctcttcctaactttcaaatccctcagggatcggagggaggattgatgaaccaacaaggacaaacgcaaacgcaaacgcaacctcaggcgagcgcgtctacagctactggcggtacggtggcggctccgccgcagagtaggactaaaatccgagctaggagaggtcaagcaactgatcctcatagtatcgccgaaaggttacgaagagagagaattgcggaaagaatgaaagctcttcaagaactcgttcctaacggcaataagacagacaaggcatcgatgctcgatgagatcatagattatgtcaagtttttacaactccaagtcaaggtactgagcatgagcagattgggaggtgctgcttccgtttcttctcaaatctccgaggctggtggatcccacgggaacgcatcctccgccatggtcggcggtagccagacggccggaaactccaacgacagcgttacaatgacggaacatcaagtggccaaactaatggaagaagacatgggctcggccatgcaatatcttcaagggaaaggtctttgtctcatgccaatctctttagccaccgccatctcaaccgccacgtgtcactcccgtaaccctttgatccctggagctgttgccgacgccggaggtccttcccctcccaatctttctgccatgaccatacagtcgacgagtacaaaaatgggtagcggtaatgggaaattaaacggtaacggcgtgaccgagaggtcgtcttctatcgccgttaaagaggccgtatccgtttcgaaagcgtgataacggccgtttacttttggggttaggcagagagataccaaaaacaaagagaaagtggggtgaagtgggagataaagtcaaagtctacgaagaatgaggttgaggttgtttgatgtgttctctcaacgaagccatatttttcgtagagttttggttcttttacctacgcactacaaaaccactcaagggacatttctttttcttttttaaatatatggtgc

SEQ ID NO: 1488 - protein, 350 aa, Arabidopsis thaliana
  G1061 Amino Acid Sequence
MMNSSLLTPSSSSSSHIQTPSTTFDHEDFLDQIFSSAPWPSVVDDAHPLPSDGFHGHDVDSRNQPIMMMPLNDGSSVHGLYNGFSVAGSLPNFQIPQGSEGGLMNQQGQTQTQTQPQASASTATGGTVAAPPQSRTKIRARRGQATDPHSIAERLRRERIAERMKALQELVPNGNKTDKASMLDEIIDYVKFLQLQVKVLSMSRLGGAASVSSQISEAGGSHGNASSAMVGGSQTAGNSNDSVTMTEHQVAKLMEEDMGSAMQYLQGKGLCLMPISLATAISTATCHSRNPLIPGAVADAGGPSPPNLSAMTIQSTSTKMGSGNGKLNGNGVTERSSSIAVKEAVSVSKA

SEQ ID NO: 1489 - DNA, 2532 bp, Arabidopsis thaliana
  G1061 Genomic Sequence
tcacgctttcgaaacggatacggcctctttaacggcgatagaagacgacctctcggtcacgccgttaccgtttaatttcccattaccgctacccatttttgtactcgtcgactgtatggtcatgccagaaagattgggaggggaaggacctccgacgtcggcaacagctccagggatcaaagggttacgggagtgacacgtggcggttgagatggcggtggctaaagagattggcatgagacaaagacctttcccttgaagatattgcatggccgagcccatgtcttcttccattagtttggccacttgatgttccgtcattgtaacgctgtcgttggagtttccggccgtctggctaccgccgaccatggcggaggatgcgttcccgtgggatccaccagcctaagcaaaataaaacaaaacattttgaaaaacaaaaagacaaagaaagcgaaaccctaagtgattagtcggcacgcgtgctctcttttatatttctctattttagaattataaaatttgtcttatttgttttctgtttctggaaactttttacattcattttgttttcaacgtcttgcacgatttatctatttttacacaccaaaataatattttgtaaaatctaattaacattataagagaaaagtgattgtctaatttcttaattttgtccattggctttgatgtttattgaaatttatgaaaaatgagtacgtagagatagtaatatattagttacctcggagatttgagaagaaacggaagcagcacctcccaatctgctcatgctcagtacctaaaacgcataattaaattcaaaacagaatgattaagtacactggtccactaatttataacttaaaaacattatttatcatgtatgtatttatatgacataataatccagaatgtatatataaaatttgaggagggagcataaggaattttagttgcagaggcccataaatttgatatattggtatgtaaagattgtactaatatgtcagcttttctttttgtttaatatgtcaaactaaaaggcaaaaaaacgaatcttccatctatattgaagagaataaaataaaacaaattgcactctgtaaaagaattaccccttgtacgtatgaaaaacaaacttaataaaataataactgtaaatatatgagagagagggagagattcaccttgacttggagttgtaaaaacttgacataatctatgatctcatcgagcatcgatgccttgtctgtctgtccattattatacaaataaaatacaaaaacaaaactgtcagaactgagatcctaactcatttattactgcattagttaactttattattgtagcctaattaattaattagctaatcagtgtttaatcatttgattgatatatactactagctactcctatatatagatagactacacaaccaccaattatatgagtaaaacaaaaaatataaatttacttgttaactcctgaaagttctagttgacagcctaaaactatctcttgaacaactagctccaagaaagttcctgatcatttcgacacttattttcattatttattttgtattttttcaattttaggtctagaagatgagaactataaatagacgatggagtttaaattgtaaattagatggaattatggatcgcacgaatcaagagtggatgatgaataaaatgatggaaagtgaagtttattttcataatgatccatttaatattttaactaatcttaatttttggaaactaaactgaaaatgaattgaataaaaatttaccttattgccgttaggaacgagttcttgaagagctttcattctttccgcaattctctctcttcgtaactgtcccataaaaacattttttccagaaaatactcaaatcttttcttcaaaaagctaaaaaaaattcaatttcgacacctttctcggtaactgatacaaattaatgcatcgaacaaagtaaaataaaaaacaaaaacaactaaccctttcggcgatactatgaggatcagttgcttgacctctcctagctcggattttagtcctactctgcggcggagccgccaccgtaccaccagtagctgtagacgcgctcgcctgaggttgcgtttgcgtttgcgtttgtccttgttggttcatcaatcctcctcccgatccctatatttcaccataagtctcgttttcaagaagagaaaaacttagaaaagagaaagagattatacctgagggatttgaaagttaggaagagatccggcgacggagaagccattataaagagcgtggacggaggagccatcattcaaaggcatcatcatgatcggctgattccttgagtcgacatcgtggccgtggaagccatcggagggaagaggatgagcatcatcgacgacggagggccacggggccgaggaaaagatttgatcgaggaagtcttcgtggtcgaaagttgttgatggagtttggatatgggaagaagatgaagaagaaggagttagaagagaagagttcatcat

SEQ ID NO: 1490 - DNA, 2532 bp, Arabidopsis thaliana; identical to SEQ ID NO: 1489
  G1061 DNA sequence used for BLAST

SEQ ID NO: 1491 - DNA, 869 bp, Arabidopsis thaliana
  G1065 cDNA Sequence
cggacgcgtgggtttggttttcttttttcctctctatttcttcggctgagaggcggcgactatggcggaggaacagaagatagcgttagaatcagaatctccggcgaaggttacgactcctgctccagcagatacaccggctccagctccggcagagattccggctccagctccagctccgactccggctgatgtcacgaaagacgttgcagaggagaaaattcaaaacccacctccggagcaaattttcgatgactccaaagcccttactgttgttgagaaacctgtagaagagcctgcaccggcgaaacctgcgtctgcatcgctcgatagagatgttaagctagctgatttgtcaaaggaaaagagattgtctttcgtcagagcgtgggaagaaagcgaaaagagcaaagcagagaacaaagctgagaagaagattgcagatgttcatgcttgggaaaacagcaagaaagcagctgtcgaagcgcaactcaagaaaatcgaggagcaactagagaagaagaaagcagagtatgcagagaggatgaagaataaggttgcagcgattcacaaggaagcagaagagagaagagcaatgattgaagctaagcgtggagaagacgttcttaaagcagaagaaacggctgctaaatacagagccactggaattgttccaaaggcaacttgtggatgtttctaatcttgaatttgcgaatcaaagtttcaagacttcgtaactgtaaagtgtaatcaaatttctctgttctctttaatggcttgtaatgttgtttgtatattgattttgtgtgtgacaatcagagtgaaaaatatgtttcattgttttctaaaaaaaaaaaaaaaaaaaaaaa

SEQ ID NO: 1492 - protein, 212 aa, Arabidopsis thaliana
  G1065 Amino Acid Sequence
MAEEQKIALESESPAKVTTPAPADTPAPAPAEIPAPAPAPTPADVTKDVAEEKIQNPPPEQIFDDSKALTVVEKPVEEPAPAKPASASLDRDVKLADLSKEKRLSFVRAWEESEKSKAENKAEKKIADVHAWENSKKAAVEAQLKKIEEQLEKKKAEYAERMKNKVAAIHKEAEERRAMIEAKRGEDVLKAEETAAKYRATGIVPKATCGCF

SEQ ID NO: 1493 - DNA, 1299 bp, Arabidopsis thaliana
  G1065 DNA sequence used for BLAST
ttagaaacatccacaagttgcctttggaacaattccagtggctctgtatttagcagccgtttcttctgctttaagaacgtcttctccacgcttagcttcaatcattgctcttctctcttctgcttccttgtgaatcgctgcaaccttattcttcatcctctctgcatactctgctttcttcttctctagttgctcctgcattgagaaaaaactcacaaattaacacttcacttctcaatcacattaaaaccgtttcacctctctattgctaagtttattatacctcgattttcttgagttgcgcttcgacagctgctttcttgctgttttcccaagcatgaacatctgcaatcttcttctcagctctgtttcatgtcaatagtcagcaaaatcaggcaaagaacataaaaaagccaaaacctaaaaccagtgacgataaaataaaatgtcttacttgttctctgctttgctcttttcgctttcttcccacgctctgacgaaagacaatctcttttcctttgacaaatcagctagcttaacatctacaaaccaaacaatggaactcagaaactttaacaaacattacatccagaaagaagtcacacaattttgtttaagctcacctctatcgagcgatgcagacgcaggtttcgccggtgcaggctcttctacaggttctgtaaaaaaattcattccgttaaaatttcaaacataaccagcaaaattgccacagaagagagtcacaagcaaacacatacaaaacatatgcatggttatgaacataaagctacaatttttgggtgcttaatgaccatatacattgaattatacatcacaacaaaactaaatttaccaatctcgagactttaaatcgaaacgaattcgaatttaactgtgcactctaatcgtatttcaatgacaaattctatctctggagcaacccaatcctaataaccaataaaacctaatttttaaaatacagaaccaagttaaccccaaaaccaatatttcctcgtcaaagcagaagattatcagagaacagaatccataattacatgcgttaagagaaattaacttactctcaacaacagtaagggctttggagtcatcgaaaatttgctccggaggtgggttttgaattttctcctctgcaacgtctttcgtgacatcagccggagtcggagctggagctggagccggaatctctgccggagctggagccggtgtatctgctggagcaggagtcgtaaccttcgccggagattctgattctaacgctatcttctgttcctccgccat

SEQ ID NO: 1494 - DNA, 1473 bp, Arabidopsis thaliana
  G1067 cDNA Sequence
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 1495 - protein, 311 aa, Arabidopsis thaliana
  G1067 Amino Acid Sequence
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 1496 - DNA, 936 bp, Arabidopsis thaliana
  G1067 Genomic Sequence
ttaaaaaggtggtcttgaaggtgttccagctccccatccaagcaaatgaggatcaccagaaaacccataaccacccacattacctcctaactgtccctgaccggtcactccagacggcggagatgctgatggagcttgttgcatctgcggtggccctcctcctcctcctcctccgccaccaccaccttcttcttcctcctcctcaatcggtagtctctcgaaaaccgcatttgagaacgaagccgccattagtataaccggagctgatgcaataaggggagccacaacgcttcctccgaccacctgaccttgccctccggctaaaaatatagacaaaccaccggcaccaggcggtgcaggaggtggcaaaacagtccccgttagcgaaagaatctcaaaccttccatgtaaagtcacaactcctcctcctccggacacaccaccgccatttccaggagtgactggctgacggagagtgacgttagatacggtgccgtttcctcctaaaacggagacgcctctccctctcctcctagcgtacgtggaaacactctcaactatgtcagctccaggagatacttcaagaacgtgagatctaagcgcgttggggctatcacgagttactatgatcggtggcttggctttgttcttagatcctggtggacgtccacgtggacgttttcccggtgctgagcttgatgtattcgggtctgaatcgggtcgaccctgttgatgatgatctttgtttgaatggtcagattctcttgaatcatccgacggttgttgttgttgttgatgttgctggtgctgatgatgatgctggtcgataagattgatcccgccctgcggttgaagctgttggtggtgaatctccggtctaaagaggttatggaagtatctagaagctccaccgccttgctcgtaaccgccttccat

SEQ ID NO: 1497 - DNA, 936 bp, Arabidopsis thaliana; identical to SEQ ID NO: 1496
  G1067 DNA sequence used for BLAST

SEQ ID NO: 1498 - DNA, 1606 bp, Arabidopsis thaliana; identical to SEQ ID NO: 72
  G1068 cDNA Sequence

SEQ ID NO: 1499 - protein, 386 aa, Arabidopsis thaliana
  G1068 Amino Acid Sequence
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 1500 - DNA, 1713 bp, Arabidopsis thaliana
  G1068 Genomic Sequence
atggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttgatggatcgccttcttctgttgccgccactcaacaacattcgatgagatttgggatcgaccatcaacaggttaagaagaaacgaggtagacctaggaagtatgctgctgatggtggtggtggtggtggtggtggtagtaacattgctcttggtttggctcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggtacaggatctatctctatctctctctctctttctcttatcaaatcaaattcactgttttacaattttacttaatgggttttgtcctctgtgtgtgtgtgtgagcaggaggaacaggaggagttgggttcacgcctcatgtcattgaggttaaaacaggagaggtaatgtgttgatgtagcaaatctttaatcttcaatttgtttctttggttaaagttatgatctttcattgtattcaggacatagctacgaagatattggcgtttacgaaccaagggccacgcgcaatctgtattctctcagctacaggagctgtaactaatgtgatgcttcgtcaagctaacaatagcaatcctactggaactgttaagtatgaggtataaaattactcatgtgctttgtgcattgcttgcttcttggcctcattttgagctctgttgttatcgaatggagctggaatttaaatcttgtattgagctgtattggatgtgttgttgtttcagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtttgtcaaattcttaacctttacacttgagttaagatcagaaagtattcaagatactgactttgattggggtttttatataggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataa

SEQ ID NO: 1501 - DNA, 1807 bp, Arabidopsis thaliana
  G1068 DNA sequence used for BLAST
tcaatctactttatagagataaatctgatggagagatgtgtcaaaaggaacagagaagcaaacccggtcaaatcttgacccatgaaccatctgtttattgaggactgttgccaggccagagattctggtacatctgcataggaatttggtgaagcggttgaggtgtagagtttccaaatatcccatgattgttgctgttgttgttgttgcttctacggtgcaacggagaattactttcgttttcctctgatgactcgctcgagtgttgttgtccttgagatcgagggcttcccggtccaccaacaccaccaaagctcaacatattggctggtgctgaagctggctccggagtattctgagcacgccccgcactttgtttctgcttccttccatctggtacaaagcttcccacaatgacctatataaaaaccccaatcaaagtcagtatcttgaatactttctgatcttaactcaagtgtaaaggttaagaatttgacaaacctggacttgtgatccagctactagcattccatcaacacatccacccacaatccggccttcgtgtccagccagcgacacactcaagttaccagttttggtcacagtaccattactctcagaattcaagaaagaacctgacagagaaatgatttcaaatcggccctgaaacaacaacacatccaatacagctcaatacaagatttaaattccagctccattcgataacaacagagctcaaaatgaggccaagaagcaagcaatgcacaaagcacatgagtaattttatacctcatacttaacagttccagtaggattgctattgttagcttgacgaagcatcacattagttacagctcctgtagctgagagaatacagattgcgcgtggcccttggttcgtaaacgccaatatcttcgtagctatgtcctgaatacaatgaaagatcataactttaaccaaagaaacaaattgaagattaaagatttgctacatcaacacattacctctcctgttttaacctcaatgacatgaggcgtgaacccaactcctcctgttcctcctgctcacacacacacacagaggacaaaacccattaagtaaaattgtaaaacagtgaatttgatttgataagagaaagagagagagagatagagatagatcctgtacctaaagcatcgagctgcttcttaccggagccaggaggacgtcctctgttccgtttagcaggtggatcggaagagttagcattagctccggcgctatcaccaccaccacctccttcatttccaccaccgtaagaattagaagcagaaggaagaggcgaagtaggagccaaaccaagagcaatgttactaccaccaccaccaccaccaccaccatcagcagcatacttcctaggtctacctcgtttcttcttaacctgttgatggtcgatcccaaatctcatcgaatgttgttgagtggcggcaacagaagaaggcgatccatcaaatccaagagattcaagagtcttctgatctatctgttgctgaggctgaggatgatgatactgatgttgttgaggctgatgcggtgacatagaaccaccaaaaggtaatctttgatgcatagcttgagatgtggaggtgttgtgacccattaaaacagcggcggcggcgttagggtttcgattgtaggaattgtggtgactcattaacatccctggcggtggttgttgctgttgttgtagatgttgctgttgttgctgctgctgctgttgttgttgttgttgttgctgttgttggtggtggatctctctggaatccat

SEQ ID NO: 1502 - DNA, 1668 bp, Arabidopsis thaliana
  G1071 cDNA Sequence
gagagagtctgttagaggttttttgtttgtttctgtttccttctgtcacccagaaaactaaaaagcaaacaaattcaagaagagagagagagagagatagcctcaaaaccaagtcctaaccattgttgatagaagagaaagcttttcttttcttgttgcttatggtgaaaaatgaaagagagagaggaggagaagtaagaagcagagaaagtgtttagagctttgcatgttcctttctctccaagtttatatcttcatcggtttcacaagttcacttaaaaagttgaaaagagtctttcttcttcaactattgtaaatgcgaaatggatcgaagagatgcaatgggattatccgggtcaggttcttactatatccatagaggattatccgggtcgggtcctccaacgtttcatggatcaccacagcaacagcaaggtcttcgtcacttacctaatcaaaactctccattcgggtcaggctccactggtttcggatctccttctttacacggtgatccttctctggcaacagcagccggaggagccggagctcttcctcatcatatcggcgttaatatgattgctcctcctccacctcccagtgaaactccgatgaaacgaaagagaggacggcctagaaaatacggtcaagacggctctgtttctttggctctgtcgtcttcctctgtttcgaccattactcccaacaactctaacaaacgcggccgtggtcgacctccgggctccggcaagaaacagagaatggcttccgttggtgaactgatgccttcatcttctggaatgagcttcacgccacatgttatcgcggtttcaataggagaagatattgcatcaaaggttatagctttctctcaacaaggtccgagagccatttgcgttttatctgcaagtggtgcagtctctactgcaacacttattcaaccatcagcatctcccggagccattaaatacgagggccggtttgaaatcctagcgttatcaacatcttatatagtggcaactgatggaagcttccgtaaccgaactggaaacttatcggtttcgcttgctagccccgatgggcgtgtgattggcggtgccattggtgggcctttaatagctgcaagtcctgttcaggttattgtagggagctttatatgggcagctccaaagatcaagagcaagaaacgagaagaagaagcttctgaagttgttcaagaaactgatgatcaccacgttctggacaataataacaacacgatttcgcctgtccctcagcagcagccaaaccaaaacctgatttggtcaacaggttcaaggcaaatggatatgcgtcatgctcatgctgatattgatttaatgcgcggttgatgatagcgagaaagaactctgtgtatataaagcatggaatctaggaagaagaagaaggaatataagctaacctctgaacaaaagtatgtggaaatgttagggaaaaagattatgtggaaatgttagggaaaaagattaactctattagtgtacctctcatatctctaagcttgtttggttttactgtttctgtgactctgaagatttgcagagttcctttctttctctgttttagattgttcagtctttatgtaatttgcttgcaattctgattctacagcttagattccaaaaaaaa

SEQ ID NO: 1503 - protein, 348 aa, Arabidopsis thaliana
  G1071 Amino Acid Sequence
MDRRDAMGLSGSGSYYIHRGLSGSGPPTFHGSPQQQQGLRHLPNQNSPFGSGSTGFGSPSLHGDPSLATAAGGAGALPHHIGVNMIAPPPPPSETPMKRKRGRPRKYGQDGSVSLALSSSSVSTITPNNSNKRGRGRPPGSGKKQRMASVGELMPSSSGMSFTPHVIAVSIGEDIASKVIAFSQQGPRAICVLSASGAVSTATLIQPSASPGAIKYEGRFEILALSTSYIVATDGSFRNRTGNLSVSLASPDGRVIGGAIGGPLIAASPVQVIVGSFIWAAPKIKSKKREEEASEVVQETDDHHVLDNNNNTISPVPQQQPNQNLIWSTGSRQMDMRHAHADIDLMRG

SEQ ID NO: 1504 - DNA, 1752 bp, Arabidopsis thaliana
  G1071 Genomic Sequence
atgttcctttctctccaagtttatatcttcatcgtaaagtctctcaacctttgattctgttttttcctcttatccatttatcctctttctttttctctctctcctcataattctagccacaatctttttagggtttcacaagttcacttaaaaagttgaaaagagtctttcttcttcaactattgtaaatgcgaaatggatcgaagagatgcaatgggattatccgggtcaggttcttactatatccatagaggattatccgggtcgggtcctccaacgtttcatggatcaccacagcaacagcaaggtcttcgtcacttacctaatcaaaactctccattcgggtcaggctccactggtttcggatctccttctttacacggtgatccttctctggcaacagcagccggaggagccggagctcttcctcatcatatcggcgttaatatgattgctcctcctccacctcccagtgaaactccgatgaaacgaaagagaggacggcctagaaaatacggtcaagacggctctgtttctttggctctgtcgtcttcctctgtttcgaccattactcccaacaactctaacaaacgcggccgtggtcgacctccgggctccggcaagaaacagagaatggcttccgttggtaattaactatctatctctgaaacttgcaatcttgaaaaaagaaagctccattatatattgaatcaagaaccaggattattttatgttttctcaagtcaaaatatccaattgtttattcctaatgagtgggaacttaaaactttcctaaattggaactaattttgttgtctttctttgtattatgctctgcttaaactcttatgaattagactcgcatttattgattcaatgagcctgttttttttgttcttttgaaattgattaggtgaactgatgccttcatcttctggaatgagcttcacgccacatgttatcgcggtttcaataggagaagtaatgttgaatcactaactatttcagagctttcgtgaaatgttttttatttgctgattgctgaaaagctttgaaactttgcaacaggatattgcatcaaaggttatagctttctctcaacaaggtccgagagccatttgcgttttatctgcaagtggtgcagtctctactgcaacacttattcaaccatcagcatctcccggagccattaaatacgaggttcaattttgaaatttcttactatatagagaaacattggtgttttcactgtttttcttataacatatgtttttgtatatttccagggccggtttgaaatcctagcgttatcaacatcttatatagtggcaactgatggaagcttccgtaaccgaactggaaacttatcggtttcgcttgctagccccgatgggcgtgtgattggcggtgccattggtgggcctttaatagctgcaagtcctgttcaggtttggtttacacttttctcttgagctctcatatttcttgggattgaataaagattcttgggtctatcaggttattgtagggagctttatatgggcagctccaaagatcaagagcaagaaacgagaagaagaagcttctgaagttgttcaagaaactgatgatcaccacgttctggacaataataacaacacgatttcgcctgtccctcagcagcagccaaaccaaaacctgatttggtcaacaggttcaaggcaaatggatatgcgtcatgctcatgctgatattgatttaatgcgcggttga

SEQ ID NO: 1505 - DNA, 1557 bp, Arabidopsis thaliana
  G1071 DNA sequence used for BLAST
atggatcgaagagatgcaatgggattatccgggtcaggttcttactatatccatagaggattatccgggtcgggtcctccaacgtttcatggatcaccacagcaacagcaaggtcttcgtcacttacctaatcaaaactctccattcgggtcaggctccactggtttcggatctccttctttacacggtgatccttctctggcaacagcagccggaggagccggagctcttcctcatcatatcggcgttaatatgattgctcctcctccacctcccagtgaaactccgatgaaacgaaagagaggacggcctagaaaatacggtcaagacggctctgtttctttggctctgtcgtcttcctctgtttcgaccattactcccaacaactctaacaaacgcggccgtggtcgacctccgggctccggcaagaaacagagaatggcttccgttggtaattaactatctatctctgaaacttgcaatcttgaaaaaagaaagctccattatatattgaatcaagaaccaggattattttatgttttctcaagtcaaaatatccaattgtttattcctaatgagtgggaacttaaaactttcctaaattggaactaattttgttgtctttctttgtattatgctctgcttaaactcttatgaattagactcgcatttattgattcaatgagcctgttttttttgttcttttgaaattgattaggtgaactgatgccttcatcttctggaatgagcttcacgccacatgttatcgcggtttcaataggagaagtaatgttgaatcactaactatttcagagctttcgtgaaatgttttttatttgctgattgctgaaaagctttgaaactttgcaacaggatattgcatcaaaggttatagctttctctcaacaaggtccgagagccatttgcgttttatctgcaagtggtgcagtctctactgcaacacttattcaaccatcagcatctcccggagccattaaatacgaggttcaattttgaaatttcttactatatagagaaacattggtgttttcactgtttttcttataacatatgtttttgtatatttccagggccggtttgaaatcctagcgttatcaacatcttatatagtggcaactgatggaagcttccgtaaccgaactggaaacttatcggtttcgcttgctagccccgatgggcgtgtgattggcggtgccattggtgggcctttaatagctgcaagtcctgttcaggtttggtttacacttttctcttgagctctcatatttcttgggattgaataaagattcttgggtctatcaggttattgtagggagctttatatgggcagctccaaagatcaagagcaagaaacgagaagaagaagcttctgaagttgttcaagaaactgatgatcaccacgttctggacaataataacaacacgatttcgcctgtccctcagcagcagccaaaccaaaacctgatttggtcaacaggttcaaggcaaatggatatgcgtcatgctcatgctgatattgatttaatgcgcggttga

SEQ ID NO: 1506 - DNA, 1464 bp, Arabidopsis thaliana
  G1072 cDNA Sequence
gacactatgtttttttttcttcttcttgtttggatcatataaatctgattttttcccggaaaataccgttgagaacttctccggcgtgagctgaccaggagaaatctgttcttgtgtttagttcaattctcggctgaggaacgttgactgttgactgatagagcaacttcagtgtgttgagactaaacataaagcttcagttaaggataggatttgagaatggaaacaagcgacagaattagccctggtggtggtataggagcagaagttccatcagcgtatcatatggctccgagaccttcagatagccctgctaaccagtttatggggttgtctctccctcccatggaagccccaatgccttcttcaggggaagcctcagggaagaagaggagaggcagacctcgtaaatatgaagctaatggtgctcctttgccttcttcatcagttcctcttgtgaagaaacgagtaagaggcaagctcaatggttttgatatgaagaagatgcataagaccattgggttccattcttctggtgaaaggtttggtgttggtggtggtgttggtggtggtgttggatcaaatttcacgccgcatgtaatcacagtgaacactggtgaggatattactatgagaatcatctccttttcacaacaaggaccacgagctatttgtatcttatcagcaaatggagtgatatcaaacgttactcttcgccaacccgattcttgcggtggtactctcacctacgagggtcggtttgagatactgtctctgtctggttcattcatggaaacagagaatcaaggttcaaaaggtcggtctggtggcatgagtgtatctttggccggtcctgatggtcgtgttgtcggtggcggtgtcgctggcctgctcattgccgccactcctattcaggttgttgttggcagttttataacgagtgatcaacaagatcatcagaaaccgaggaagcaaagagtcgagcatgcccctgcagcagtcatgtcagtgcctcctcctccttctcctcctcctccggcggcttctgttttctcaccgacaaacccggacagagagcagccgccatcttcattcggtatctccagctggaccaacggacaggacatgccgagaaactcagccactgacatcaacatatctttaccagtcgactgagtttgagtttccagatggaagattaggtttcagattaactctctactgtctgtacaatggttaggaggattgttgaagctgaatgttactgtacgcttttctttattttagaacacaacttgagcttcttctacttttagggtaactttctctgatgacttgcctcttgttacttactatattgctagtactgaggtttaatccttttaatggcggattaatctgtgttgttcccttttagttgttttctttattgatattttacactatttagtatcccccaaaaaa

SEQ ID NO: 1507 - protein, 318 aa, Arabidopsis thaliana
  G1072 Amino Acid Sequence
METSDRISPGGGIGAEVPSAYHMAPRPSDSPANQFMGLSLPPMEAPMPSSGEASGKKRRGRPRKYEANGAPLPSSSVPLVKKRVRGKLNGFDMKKMHKTIGFHSSGERFGVGGGVGGGVGSNFTPHVITVNTGEDITMRIISFSQQGPRAICILSANGVISNVTLRQPDSCGGTLTYEGRFEILSLSGSFMETENQGSKGRSGGMSVSLAGPDGRVVGGGVAGLLIAATPIQVVVGSFITSDQQDHQKPRKQRVEHAPAAVMSVPPPPSPPPPAASVFSPTNPDREQPPSSFGISSWTNGQDMPRNSATDINISLPVD

SEQ ID NO: 1508 - DNA, 1452 bp, Arabidopsis thaliana
  G1072 Genomic Sequence
atggaaacaagcgacagaattagccctggtggtggtataggagcagaagttccatcagcgtatcatatggctccgagaccttcagatagccctgctaaccagtttatggggttgtctctccctcccatggaagccccaatgccttcttcaggggaagcctcagggaagaagaggagaggcagacctcgtaaatatgaagctaatggtgctcctttgccttcttcatcagttcctcttgtgaagaaacgagtaagaggcaagctcaatggttttgatatgaagaagatgcataagaccattgggttccattcttctggtaaagttactcttccatttgtcactctacttaactaagcattcctttgtctgtttgattattaacattacttggtcttttgcataaagttatgaaagattattaacaactgttaaaagtttctcaagaagttgcatttgttttgtttaaagtagcatatgggctttaactttgttgagtgagtatctattataattgtttgaagattgtaactttgaatcattgtcttgcaggtgaaaggtttggtgttggtggtggtgttggtggtggtgttggatcaaatttcacgccgcatgtaatcacagtgaacactggtgaggtatgtatattagaagaaaaaggccctaaactttcacttgggaggagatttgtgtttgttacttagcaacaactctgtttgctttgttttgattgaaggatattactatgagaatcatctccttttcacaacaaggaccacgagctatttgtatcttatcagcaaatggagtgatatcaaacgttactcttcgccaacccgattcttgcggtggtactctcacctacgaggtttgtctctcacactccatttaaagctatcagagagaaagtgaaagtgtcatattataatgtgttggtttcttgcagggtcggtttgagatactgtctctgtctggttcattcatggaaacagagaatcaaggttcaaaaggtcggtctggtggcatgagtgtatctttggccggtcctgatggtcgtgttgtcggtggcggtgtcgctggcctgctcattgccgccactcctattcaggtgactcatgaatctaacaacaacgtttacgttatttcttgaaatcgtctctcatctcatcaagttttgttgtttcttaaacacaggttgttgttggcagttttataacgagtgatcaacaagatcatcagaaaccgaggaagcaaagagtcgagcatgcccctgcagcagtcatgtcagtgcctcctcctccttctcctcctcctccggcggcttctgttttctcaccgacaaacccggacagagagcagccgccatcttcattcggtatctccagctggaccaacggacaggacatgccgagaaactcagccactgacatcaacatatctttaccagtcgactga

SEQ ID NO: 1509 - DNA, 1452 bp, Arabidopsis thaliana
  G1072 DNA sequence used for BLAST
tcagtcgactggtaaagatatgttgatgtcagtggctgagtttctcggcatgtcctgtccgttggtccagctggagataccgaatgaagatggcggctgctctctgtccgggtttgtcggtgagaaaacagaagccgccggaggaggaggagaaggaggaggaggcactgacatgactgctgcaggggcatgctcgactctttgcttcctcggtttctgatgatcttgttgatcactcgttataaaactgccaacaacaacctgtgtttaagaaacaacaaaacttgatgagatgagagacgatttcaagaaataacgtaaacgttgttgttagattcatgagtcacctgaataggagtggcggcaatgagcaggccagcgacaccgccaccgacaacacgaccatcaggaccggccaaagatacactcatgccaccagaccgaccttttgaaccttgattctctgtttccatgaatgaaccagacagagacagtatctcaaaccgaccctgcaagaaaccaacacattataatatgacactttcactttctctctgatagctttaaatggagtgtgagagacaaacctcgtaggtgagagtaccaccgcaagaatcgggttggcgaagagtaacgtttgatatcactccatttgctgataagatacaaatagctcgtggtccttgttgtgaaaaggagatgattctcatagtaatatccttcaatcaaaacaaagcaaacagagttgttgctaagtaacaaacacaaatctcctcccaagtgaaagtttagggcctttttcttctaatatacatacctcaccagtgttcactgtgattacatgcggcgtgaaatttgatccaacaccaccaccaacaccaccaccaacaccaaacctttcacctgcaagacaatgattcaaagttacaatcttcaaacaattataatagatactcactcaacaaagttaaagcccatatgctactttaaacaaaacaaatgcaacttcttgagaaacttttaacagttgttaataatctttcataactttatgcaaaagaccaagtaatgttaataatcaaacagacaaaggaatgcttagttaagtagagtgacaaatggaagagtaactttaccagaagaatggaacccaatggtcttatgcatcttcttcatatcaaaaccattgagcttgcctcttactcgtttcttcacaagaggaactgatgaagaaggcaaaggagcaccattagcttcatatttacgaggtctgcctctcctcttcttccctgaggcttcccctgaagaaggcattggggcttccatgggagggagagacaaccccataaactggttagcagggctatctgaaggtctcggagccatatgatacgctgatggaacttctgctcctataccaccaccagggctaattctgtcgcttgtttccat

SEQ ID NO: 1510 - DNA, 974 bp, Arabidopsis thaliana; identical to SEQ ID NO: 59
  G1073 cDNA Sequence

SEQ ID NO: 1511 - protein, 270 aa, Arabidopsis thaliana
  G1073 Amino Acid Sequence
MELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 1512 - DNA, 813 bp, Arabidopsis thaliana
  G1073 Genomic Sequence
atggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttag

SEQ ID NO: 1513 - DNA, 813 bp, Arabidopsis thaliana
  G1073 DNA sequence used for BLAST
ctaaaacgcgggtctagtcgcaccgccaccacctcctccgctaccgccgctcataccgtaaatatctcccccggagaattgaaaattgttcatattcattccaagattgtagaaagcaacacctcctccaccatttccaccttggaggtttgactcacacgcctgggccccactccccgtaacctccgacgactgagacgcctccggctgctgctgctgcaccccggtggttctcggcggtggggtttcttcctcttcaatcggtaacctatcataaactgcgtttgcaaaagaagcagccatcaacactaccggtcccgaagcaattaacgaaccagccacattccctcctacaacttgtccttgacctccggctagatacaccgtcaaacctcctgctcccggtggtgcaggcggtggaagcgcagtaccggtcaaagacaaaatgtcaaaccgaccatgcagggtaatcacacctccaccagccggagccgcaggttgccgtatcgtgacgttagtgaccgcacccgtgccgcttataatgcaaacgccgcagccgcgacgagtggcgtaggtggagactgcctcggatatgtccgaaccggaggtgacttcaagaacgtgtgatctaaggacgttaggactatctctagttataatcgtcggaggtttgggtttgtttttggaacctgcaggacgaccacgtggacgacgtccggaggaagagccagaggctgtggctgagctggtggctccaccggtgggagtggtctcggcctttgcttcgtctgcttcagatctgttaagttccat

SEQ ID NO: 1514 - DNA, 1084 bp, Arabidopsis thaliana
  G1075 cDNA Sequence
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 1515 - protein, 285 aa, Arabidopsis thaliana
  G1075 Amino Acid Sequence
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 1516 - DNA, 858 bp, Arabidopsis thaliana
  G1075 Genomic Sequence
atggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttag

SEQ ID NO: 1517 - DNA, 858 bp, Arabidopsis thaliana
  G1075 DNA sequence used for BLAST
ctaaaacggagccctaccggcgccggcgtgattcccctgccaactttcaactccaatctgaggcatactcatcggcaaattaaagaaaggcaaccctccgccaccgccagtggcttccgagtacatattccctccacctccgccgccgccactttgcaagtgctcctcatgctcgtccaaaggcaacctttcgtaagccacgtttgtaaaagacgctgccatgaccattaccggccccgccgccattaactcaccaactacgttacctccgacgacctgtccttgagctccagcgaggaatatcgtcaagctagtcgcccctggaggagcaggtggcggaagaaaagatccggagagggaaagaatctcaaaagtaccccgcagagtcacaacagctccggccgccgtaggctgacggatgctgacgttagtgacggttcccgtcccggataaaacgcaaatcccgcgctgtctccgacgagcgtaagtggagatacattcgaaaacgtcgcagccacttccaacttcaagaatgtgagccctaagagtgtttgcgctctcgcgcgtgacaatcaccggcggcttcggtttgttcttcgatccagctggacggccacgtggccgacgcatgacgaggtcaccgctccctcctcctccaccgccgcctagtccagagttatcattagaagctattaaatctaaaccttgatggtgattatgattatgatggtgatgatggtggtttcctccagcgccaccgtcatcttcgtggtggttgtcggtggtgaactgtccgccgccgccaccatcgacgttgtggacgtagcgagaagttgtgcctagatcgagaccagccat

SEQ ID NO: 1518 - DNA, 2597 bp, Arabidopsis thaliana
  G1078 cDNA Sequence
agtatagtgtagtgggaaagtctggaaacagctgtatctaactttttcccttttctctatgattctgttgtgaataatgcagagccgccgtgagctcaggcgccaccgtaacgaagaacaaacctgaaggagaaaaataagccatgggatgtgcggcgtccaagctcgataacgaagatgctgtacggcgttgtaaggatcgccgccgtctgatgaaagaagctgtctacgctcgtcatcatctcgccgccgctcacgccgattactgccgatcgcttcgtatcactggatctgctctttcctcattcgcctccggtgagcctctctctgtatctgatcaaactccggctgttttcctccatactccccctcctccgctttctgaacaatctccggctaaatttgtccctccacgtttttcgccgtcgcctgctccttcttctgtttatcctccttcgacgtctccttccgtcgccagttctaagcagccttcagtcatgtccacctcttccaatcgacgccggaaacagcaaccaaaacctagactgcctcatattctctcggagtcaagtcattcttcttctccgagaagtgagagatccaatttcatgcccaatttgtatcccagtgcttatcagaactctacttactccgctactccttctcatgcctcctccgtctggaactgggagaatttctaccctccttctcctcccgattccgaattcttcaacaggaaggctcaagagaagaaacataactccgataatcgattcaacgacgaggatacggaaacagtgaggtcagagtatgatttcttcgacacgaggaagcaaaagcagaagcagttcgaatcaatgagaaatcaggtggaggaagagacggagacggagagagaggaagtacagtgtagtgaatgggaggatcacgatcattacagcaccacgagctcctcggacgcagcggaggaagaggaagaagatgatgatagagaatcaatttccgaggtcgggacacgctccgagtttggatctacggtgagaagtaattcgatgagacggcatcatcaacaaccttcaccaatgccgcaagtatacggcggcgctgaacaaagtaaatatgataaagcagatgatgctacgatatcttctggtagctatagaggcggaggagatatcgctgacatgaagatggtagttaggcatagggatttgaaagaaatcatcgatgccattaaggaaaatttcgataaggctgctgcctcaggggagcaagtctctcagatgctcgagcttggcagagctgagctcgatcgtagtttcagccaattgaagaaaacggtgattcattcgagtagtttattaagcaacttgagctcgacatggacctcgaagccgccattggcagtcaagtataggatagacacgactgcgctggatcaaccgaacagttcgaagagcctttgttccactcttgaccgtctcttggcatgggagaagaagctttatgaagaaattaaggctagagaaggtttcaagattgagcatgagaagaagttatcacagcttcaaagccaagaatataaaggggaggatgaagctaagttagacaagacaaaggcctctataacgaggttacagtcactgatcattgttacttctcaagctgttactaccacatctactgccatcatccgtcttcgtgatactgaccttgttccacaactcgttgagctctgtcatggctttatgtacatgtggaaatctatgcatcaataccatgagactcagaacagcatcgtggagcaagtccgggggctcattaacagatcgggcaaaggcgaatcaacatctgagctacaccgacaagctacacgtgacttggaatcagctgtctcttcttggcactccagtttcagtagtttgattaaattccaacgtgacttcatacactcagttcacgcctggttcaagctgacccttcttccggtttgccaagaagacgccgccaatcatcacaaagagccgctcgatgcttacgccttctgcgatgagtggaaactcgctctagatcgtattcccgatacagttgcatctgaggcaatcaagagcttcatcaacgttgtacacgtgatatccgcaaaacaagccgatgaacacaagataaagaaaagaacagaatcagcatcaaaagagcttgagaagaaggcttcgtcggttagaaacctagagagaaaatactaccagtcatactcaatggttggtgtcggtttaccagagtcaggacccgataaccgacacatgttagacgctcgagacccgttaagcgataaaaagtcagagcttgcggtttgccaaaggagagttgaggaagagatggtgaaatactcaaaggcaatagaagtgacaagagccatgactttgaataatctgcagacagggttgcctggtgtgttccaatctttaacaagtttctctgctttgttcatggagtctcttcaaacggtatgcactcgctcatactctatcaaataggacattatatattatatatatatatatattgatatgcttacagagtttacagtaacaattgtg

SEQ ID NO: 1519 - protein, 796 aa, Arabidopsis thaliana
  G1078 Amino Acid Sequence
MGCAASKLDNEDAVRRCKDRRRLMKEAVYARHHLAAAHADYCRSLRITGSALSSFASGEPLSVSDQTPAVFLHTPPPPLSEQSPAKFVPPRFSPSPAPSSVYPPSTSPSVASSKQPSVMSTSSNRRRKQQPKPRLPHILSESSHSSSPRSERSNFMPNLYPSAYQNSTYSATPSHASSVWNWENFYPPSPPDSEFFNRKAQEKKHNSDNRFNDEDTETVRSEYDFFDTRKQKQKQFESMRNQVEEETETEREEVQCSEWEDHDHYSTTSSSDAAEEEEEDDDRESISEVGTRSEFGSTVRSNSMRRHHQQPSPMPQVYGGAEQSKYDKADDATISSGSYRGGGDIADMKMVVRHRDLKEIIDAIKENFDKAAASGEQVSQMLELGRAELDRSFSQLKKTVIHSSSLLSNLSSTWTSKPPLAVKYRIDTTALDQPNSSKSLCSTLDRLLAWEKKLYEEIKAREGFKIEHEKKLSQLQSQEYKGEDEAKLDKTKASITRLQSLIIVTSQAVTTTSTAIIRLRDTDLVPQLVELCHGFMYMWKSMHQYHETQNSIVEQVRGLINRSGKGESTSELHRQATRDLESAVSSWHSSFSSLIKFQRDFIHSVHAWFKLTLLPVCQEDAANHHKEPLDAYAFCDEWKLALDRIPDTVASEAIKSFINVVHVISAKQADEHKIKKRTESASKELEKKASSVRNLERKYYQSYSMVGVGLPESGPDNRHMLDARDPLSDKKSELAVCQRRVEEEMVKYSKAIEVTRAMTLNNLQTGLPGVFQSLTSFSALFMESLQTVCTRSYSIK

SEQ ID NO: 1520 - DNA, 1879 bp, Arabidopsis thaliana
  G1078 DNA sequence used for BLAST
ttatcttgtgttcatcggcttgttttgcggatatcacgtgtacaacgttgatgaagctcttgattgcctcagatgcaactgtatcgggaatacgatctagagcgagtttccactcatcgcagaaggcgtaagcatcgagcggctctttgtgatgattggcggcgtcttcttggcaaaccggaagaagggtcagcttgaaccaggcgtgaactgagtgtatgaagtcacgttggaatttaatcaaactactgaaactggagtgccaagaagagacagctgattccaagtcacgtgtagcttgtcggtgtagctcagatgttgattcgcctttgcccgatctgttaatgagcccccggacttgctccacgatgctgttctgagtctcatggtattgatgcatagatttccacatgtacataaagctgcatccggtggaaaacaaacccaaagattaatgtctccaaaggtcaaaattaatgtcttgttttgattttgtttaacaaaatgtccagagactcgaattgattacagaattcacatgatgaataccagaaaccagaagacattcatttctggcaaaactagaaattagtcagtacgcctaaccaacaatgttattgcctctcaactaattaccaatttcagcaacttactataaaactttcacaggataagctataaaacttaaaaagctaagaaataaattgtaacaattgacaagagaggtaagagacctttttgtctcactctaagcatatcaaggaccacagaattctaaaacgcatgggctcataattgttcacctacttattgagtccacaagattctttcaaaaatatgaaaagtaggtggcaatgaataataatactatactgaatttaagaaaccaaatgggtaaagaataatgattgcttgccaaaaatgtcagattcaagaaaactgttggatcacaagataacatcagcatctggtgattcagttatatatagagagaaaacttacccatgacagagctcaacgagttgtggaacaaggtcagtatcacgaagacggatgatggcagtagatgtggtagtaacagcttgagaagtaacaatgatcagtgactgtaacctcgttatagaggcctttgtcttgtctaacttagcttcatcctcccctttatattcttggctttgaagctgtgataacttcttctcatgctcaatcttgaaaccttctctagcctggaaaaagaaatcatcagctaccaacaatcaattgttaaatttcataaaaggaaaaacctttgatttggacaaactgtaaaagaccttaatttcttcataaagcttcttctcccatgccaagagacggtcaagagtggaacaaaggctcttcgaactgttcggttgatccagcgcagtcgtgtctatcctatacttgactgccaatggcggcttcgaggtccatgtcgagctcaagttgcttaataaactactcgaatgaatcaccgtttctaataaacaaaattcacaatgtcacaaactcaatttcataaaagcaggataatccaagttatcaaagaaagaaaacagaacgaacaatagaactcactcttcaattggctgaaactacgatcgagctcagctctgccaagctcgagcatctgagagacttgctcccctgaggcagcagccttatcgaaattttccttaatggcatcgatgatttctttcaaatccctatgcctaactaccatcttcatgtcagcgatatctcctccgcctctatagctaccagaagatatcgtagcatcatctgctttatcatatttactttgttcagcgccgccgtatacttgcggcattggtgaaggttgttgatgatgccgtctcat

SEQ ID NO: 1521 - DNA, 2684 bp, Arabidopsis thaliana
  G1082 cDNA Sequence
gggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaatgccagaatactcggttttgcgcgtctgagactcgggc

SEQ ID NO: 1522 - protein, 846 aa, Arabidopsis thaliana
  G1082 Amino Acid Sequence
MGCTSSKLDDLPAVALCRERCAFLEAAIHQRYALAESHVAYTHSLREIGHSLHLFINHHHRFVASGGANVGDSPRLNLPPQRKGDLDDEATNSPKKQKLASSHHNHNHAHSGSGSDSGHLEFDSDSDEDEEDDDDLDLDSLHHHSPPHHHLGNFPIPESAPMGGYMEQQPGYINPYPNPDMMGHPYSGGGSYMHMNYMKNKSMPPSVVYEQRPTSPQRVYIGESSSSYPYPPQNSYFGYSNPVPGPGPGYYGSSSASTTAAATKPPPPPPSPPRSNGWDFLNPFDTYYPPYTPSRDSRELREEEGIPDLEDDDSHYEVVKEVYGKPKFAAGGGHQPNPAAVHMMREESPSPPLDKSGASTSGGGDVGDASAYQSRPSVSVEKEGMEYEVHVVEKKVVEDEERRSNATATRGGGGGGGPRAVPEVAKEIENQFVKAAESGSEIAKLLEVGKHPYGRKHAASKMLHGVTPSLPSTSGGTSSSAAAAVVPPTYADIEEELASRSRNLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQCQAIREAQGLGPIRASKKLGDEHLEATSLLGHELINWILGFSSWVSAQKGYVKELNKWLMKCLLYEPEETPDGIVPFSPGRIGAPPIFVICNQWSQALDRISEKEVIEAMRSFTTSVLQLWEQDRLDTMMTGHGDSEKKVRNMDREEQRIQREIQALEKKMILVAPGDGNSLSISGNVVYQSDTSSDSLQGSLQRIFEAMERFTAESMRAYEDLLERTNEETAPRELEEEEEE

SEQ ID NO: 1523 - DNA, 2846 bp, Arabidopsis thaliana
  G1082 Genomic Sequence
atgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatggtaaagctttgatctttttacaatgttgttacttaaagttttcagctttctgtaattggttaagtaaagttttgaacttgtatttgttttgtgtcgtgtgaattggaagcagctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggtaatggttgattttgtttttgtatcaaatctttgatcttagaacactgttcggttctgttctgttcctttgttctgaagagagagttgttctttgtgtaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggtaaatataaacttgtcttctccaaatatatacaatgttctagatatttgcaattgtagcgctaatcaaatgttgatatcggttttaattaggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaa

SEQ ID NO: 1524 - DNA, 2846 bp, Arabidopsis thaliana; identical to SEQ ID NO: 1523
  G1082 DNA sequence used for BLAST

SEQ ID NO: 1525 - DNA, 2173 bp, Arabidopsis thaliana
  G1083 cDNA Sequence
gttctttagtttgttctgttttgtaaccaccgtgagagatttcagggtagaacaaatccaaagtttcgatttttattaagtttttctcaatgggtcattcgatattggagaaaatgggatgttcaaactcgaaagcatcgatgaataagaagaacgagccgcttcatctatgcaaagaaaggaagagatttgtcaaacaagctatggattccagatgtgctttagccgctgcacacgtgtcttacatccgttcactccgtaacatcggagcttgtcttcgtcaatacgcggaggcggagactgctcatgaatcatctccgtcgttaaccgccactgagcctgagaaatctccttctcataactcctcttaccctgacgattcggttgactcgccactgagtcataactcgaatccaaaccctaaccctaaaccccttttcaatctaagttacatgaagacggagacggctagttctactgtgactttcactattaaccctctgagcgacggtgatgacgatctggaagtgacaatgccggcgttttctcctcctcctccgccgcgtcctcgccggccagagacgtcttcttgggactatttcgacacttgtgacgattttgatagctttagatttgtagggctaagtgaacaaaccgagattgatagtgaatgtgatgcagcagttataggattagagaagattactagtcaagggaatgtagcaaaatctggttcagagacattgcaagactcgagttttaaaacaaagcagaggaaacagagttgtgaagataatgatgaaagagaagatccatcggagtttatcacacatagagccaaagactttgtgtcgagtatgaaagatatagaacataagttctttagagcttctgaatctggaagagaagtttcaagaatgcttgaagttaacaaaatcagagtcggattcgccgatatgacaggaaagggaaattcaatagcgtttcttgcagctttgaagcgagcttgttgtagagggaaaagttattcaccagtttctcaagagccattgagtcatcaagttactaaagtcattgtgtggaagagaacatcgtcgtcaagatcctccacttctagaaatccgttgatccagacatcaaaagaagatcacgatgatgaaagtggaagtgatttcatcgaagagttttgtatgatctcaggaagtcactcttcttcgcttgatcggttatacgcttgggagagaaaactctatgatgaagtcaaggcgagtgagatgattaggaaagagtatgatcgaaaatgcgagcagctaaggaaccaattcgcaaaggatcacagtgctaaatcgatggataaaacaagagcagctgctaaagatcttcattcaagaatcagagtcgcgattcaatctgttgaatcgatttcaaagcggattgagagaatcagagacgatgagctccacccacagctcttagagtttcttcaagggttgataagaatgtggaaagcgatgcttgaatgtcatcatacacagtacattaccatttcattggcttaccattgtcgacattcctccaaaacagcacacgaaagtgtccttaagaggcggattttggcggagcttctagaagaaacagagtgttttggtctaagctttgtagatttggttcacagtatggcttcttatgtggaagctctgaatggttggcttcacaactgtgtcttgctccctcaagaacgttctacaagaaaccgaagaccatggtccccacgtcgtgtcctggctccaccgatattcgtgctgtgtcgggactggtctgcagggatcaaaacactgccgtctgatgaacttagcgggtcaatcaaggggttttccttggatatggagatgttgggggaagaaaaaggcggttcactgttggtttcggatttgtcgagtgtgcattcgagtttggcgaagcttctagagagattaaaaaagttttcggaagcttctttaaaaatgtatgaagatgtaaaggtgaaaagtgaagcagctagagttgcttacactaataaataattctaactgcgataggtactgaaactttgaaggaggggtattaatgtaattacgttgaacaaaattatgtacacctatggcatttactgtcttaaaatttaatttatatt

SEQ ID NO: 1526 - protein, 657 aa, Arabidopsis thaliana
  G1083 Amino Acid Sequence
MGHSILEKMGCSNSKASMNKKNEPLHLCKERKRFVKQAMDSRCALAAAHVSYIRSLRNIGACLRQYAEAETAHESSPSLTATEPEKSPSHNSSYPDDSVDSPLSHNSNPNPNPKPLFNLSYMKTETASSTVTFTINPLSDGDDDLEVTMPAFSPPPPPRPRRPETSSWDYFDTCDDFDSFRFVGLSEQTEIDSECDAAVIGLEKITSQGNVAKSGSETLQDSSFKTKQRKQSCEDNDEREDPSEFITHRAKDFVSSMKDIEHKFFRASESGREVSRMLEVNKIRVGFADMTGKGNSIAFLAALKRACCRGKSYSPVSQEPLSHQVTKVIVWKRTSSSRSSTSRNPLIQTSKEDHDDESGSDFIEEFCMISGSHSSSLDRLYAWERKLYDEVKASEMIRKEYDRKCEQLRNQFAKDHSAKSMDKTRAAAKDLHSRIRVAIQSVESISKRIERIRDDELHPQLLEFLQGLIRMWKAMLECHHTQYITISLAYHCRHSSKTAHESVLKRRILAELLEETECFGLSFVDLVHSMASYVEALNGWLHNCVLLPQERSTRNRRPWSPRRVLAPPIFVLCRDWSAGIKTLPSDELSGSIKGFSLDMEMLGEEKGGSLLVSDLSSVHSSLAKLLERLKKFSEASLKMYEDVKVKSEAARVAYTNK

SEQ ID NO: 1527 - DNA, 2269 bp, Arabidopsis thaliana
  G1083 Genomic Sequence
ttatttattagtgtaagcaactctagctgcttcacttttcacctttacatcttcatacatttttaaagaagcttccgaaaacttttttaatctctctagaagcttcgccaaactcgaatgcacactcgacaaatccgaaaccaacagtgaaccgcctttttcttcccccaacatctccatatccaaggaaaaccccttgattgacccgctaagttcatcagacggcagtgttttgatccctgcagaccagtcccgacacagcacgaatatcggtggagccaggacacgacgtggggaccatggtcttcggtttcttgtagaacgttcttgagggagcaagacacagttgtgaagccaaccattcagagcttccacataagaagccatactgtgaaccaaatctacaaagcttagaccaaaacactctgtttcttctagaagctccgccaaaatccgcctcttaaggacactttcgtgtgctgttttggaggaatgtcgacaatggtaagccaatgaaatggtaatgtactgtgtatgatgacattcaagcatcgctttccacattcttatcaacctaaagagaaaagtaaggatcaaccaacgagtctatatccaaaagttaataagacatttggttactatatacccttgaagaaactctaagagctgtgggtggagctcatcgtctctgattctctcaatccgctttgaaatcgattcaacagattgaatcgcgactctgattcttgaatgaagatctttagcagctgctcttgttttatccatcgatttagcactgtgatcctttgcgaattggttccttagctgctcgcattttcgatcatactctttcctaatcatctcactcgcctgcataaaaagaaaaacaaatgagatgtgaggaagcacaacaccaacacagccatagagtcatgatttttttaccttgacttcatcatagagttttctctcccaagcgtataaccgatcaagcgaagaagagtgacttcctgagatcatacaaaactcttcgatgaaatcacttccactttcatcatcgtgatcttcttttgatgtctggatcaacggatttctagaagtggaggatcttgacgacgatgttctcttccacacaatgactttagtaacttgatgactcaatggctctacattaaagtttaactcagaacactaaaaccaaaaatagcaaagacacaggtaaatgataaatctttaccttgagaaactggtgaataacttttccctctacaacaagctcgcttcaaagctgcaagaaacgctattgaatttccctttcctggttaacaaaacaaacactcacgaatcaacaacaggtttcaacagccatttacacaatgaaaacagaactcatacctgtcatatcggcgaatccgactctgattttgttaacttcaagcattcttgaaacttctcttccagattcagaagctctaaagaacttatgttctatatctttcatactcgacacaaagtctttggctctatgtgtgataaactccgatggatcttctctttcatcattatcttcacaactctgtttcctctgctttgttttaaaactcgagtcttgcaatgtctctgaaccagattttgctacattcccttgactagtaatcttctctaatcctataactgctgcatcacattcactatcaatctcggtttgttcacttagccctacaaatctaaagctatcaaaatcgtcacaagtgtcgaaatagtcccaagaagacgtctctggccggcgaggacgcggcggaggaggaggagaaaacgccggcattgtcacttccagatcgtcatcaccgtcgctcagagggttaatagtgaaagtcacagtagaactagccgtctccgtcttcatgtaacttagattgaaaaggggtttagggttagggtttggattcgagttatgactcagtggcgagtcaaccgaatcgtcagggtaagaggagttatgagaaggagatttctcaggctcagtggcggttaacgacggagatgattcatgagcagtctccgcctccgcgtattgacgaagacaagctccgatgttacggagtgaacggatgtaagacacgtgtgcagcggctaaagcacatctggaatccatagcttgtttgacaaatctcttcctttctttgcatagatgaagcggctcgttcttcttattcatcgatgctttcgagtttgaacatcccattttctccaatatcgaatgacccat

SEQ ID NO: 1528 - DNA, 2269 bp, Arabidopsis thaliana; identical to SEQ ID NO: 1527
  G1083 DNA sequence used for BLAST

SEQ ID NO: 1529 - DNA, 838 bp, Arabidopsis thaliana
  G1090 cDNA Sequence
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 1530 - protein, 184 aa, Arabidopsis thaliana
  G1090 Amino Acid Sequence
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 1531 - DNA, 555 bp, Arabidopsis thaliana
  G1090 DNA sequence used for BLAST
tcaattattagaattccatatggactgaaattgctgcatttcaaaaaactcatccctatcgtgctgaccaaaaaattgtccgtataattcttcgtagtcagcaacttccaaatcctgcatccaccccatcctcggcgagtctaatggagactcattaatcgcttgaatctgatccggagacaatcctactcgagaaagtccttgaccagactcgagagctggttcactcaacctacctggtttaaacataagtgctgcatcttgtgcagccgcttgaatgtgctccgaactagagctttccggccgaggaaaactgtcgacgagttccggaaagttgagattggtcccacgtcctcggaggtgaagagccgcagcatcgtaggccgctgcagccatctcggccgtctcgtagcttccaagccaaatccttgttttcttaccgggttctcggatctccgatacccatttgccccatttcctccgacgaatgcctctgtaggacaactggttaacgttgaagcggtaatctcgttggccaacgtaagtgttttccat

SEQ ID NO: 1532 - DNA, 531 bp, Arabidopsis thaliana; identical to SEQ ID NO: 108
  G1093 cDNA Sequence

SEQ ID NO: 1533 - protein, 176 aa, Arabidopsis thaliana
  G1093 Amino Acid Sequence
MGYPVGYTELLLPRIFLHLLSLLGLIRTLIDTGFRILGLPDFLESDPVSSSSSWLEPPYMSTAAHHHQESSFFFPVAARLAGEILPVIRFSELTRPGFGSGSDCCAVCLHEFENDDEIRRLTNCQHIFHRSCLDRWMMGYNQMTCPLCRTPFISDELQVAFNQRVWSESELLAESN

SEQ ID NO: 1534 - DNA, 531 bp, Arabidopsis thaliana; identical to SEQ ID NO: 108
  G1093 Genomic Sequence

SEQ ID NO: 1535 - DNA, 531 bp, Arabidopsis thaliana
  G1093 DNA sequence used for BLAST
ctaatttgattctgcgagaagttcagattcagaccaaactcgttggttaaaagcaacttgtaactcatcagaaataaacggcgttctacaaagtggacacgtcatctgattataacccatcatccaacggtctaaacagctccggtgaaatatgtgttgacaattcgtcagccgtcggatctcgtcatcgttctcgaactcgtggaggcacaccgcgcagcaatcggatccggatccgaatccgggtcgagttagctccgagaatctgatgacgggcaagatttctccagctagcctcgccgccactgggaagaaaaatgagctttcttggtgatgatgcgccgccgtggacatatacggtggttccagccatgacgatgacgatgaaaccgggtcggattcgagaaagtcgggtagacccaatatccgaaaacccgtgtctatgagtgttcgtattaagcctaagagagagagtaagtgaaggaagattcttgggaggaggagctcagtgtaccccaccggataacccat

SEQ ID NO: 1536 - DNA, 1146 bp, Arabidopsis thaliana
  G1095 cDNA Sequence
atggatctaacagaccgtcgtaacccttttaacaatcttgtttttccgccgccgcctccgccgccatccacgaccttcacaagccctatattcccacgaacaagctcttccggcaccaatttccccattctggccatcgcagtgattggaatcttagccactgcgttcttacttgtaagttactacatcttcgtgatcaaatgctgtcttaattggcaccaaatcgacatctttcgccgccgcagacgaagcagtgaccaaaaccctctaatgatttactctcctcatgaggtaaacagaggactagacgaatccgccattagagctatcccagtcttcaaattcaagaagagagacgttgttgcaggagaagaagatcagagtaagaactctcaagaatgctctgtttgtttaaacgagtttcaagaagacgagaagctaaggattattcctaactgctgccacgtgtttcacattgattgcattgatatctggcttcagggcaacgcaaattgtcccttgtgcagaaccagcgtttcttgcgaagcaagtttcactcttgacctaatctctgcaccgagctctcctcgggagaatagccctcattctcggaacaggaatctcgaacccggcctggttctaggaggcgatgatgacttcgtcgtcatagagcttggggccagtaatggtaacaacagagaaagcgtgagaaacatagacttccttacggagcaagaaagggttacctcgaatgaggtctcgaccggaaacagcccgaaatcggtgagtcctttgcctataaagtttggtaatcggggaatgtataagaaagaaaggaaatttcacaaagtgacgagtatgggagacgaatgtatcgatactagaggcaaagatggtcattttggtgaaattcagcccataagaagatcgatctcgatggattcatcagtggatcgtcagctgtacttggcggtccaagaggaaatcagccggagaaacaggcagattccggtagctggagacggtgaagatagtagcagtagtggtggtggtaatagcagagtcatgaagagatgtttcttctcttttggaagtagtagaacttcaaaaagttcttcaatattacctgtttatttggaaccctaa

SEQ ID NO: 1537 - protein, 381 aa, Arabidopsis thaliana
  G1095 Amino Acid Sequence
MDLTDRRNPFNNLVFPPPPPPPSTTFTSPIFPRTSSSGTNFPILAIAVIGILATAFLLVSYYIFVIKCCLNWHQIDIFRRRRRSSDQNPLMIYSPHEVNRGLDESAIRAIPVFKFKKRDVVAGEEDQSKNSQECSVCLNEFQEDEKLRIIPNCCHVFHIDCIDIWLQGNANCPLCRTSVSCEASFTLDLISAPSSPRENSPHSRNRNLEPGLVLGGDDDFVVIELGASNGNNRESVRNIDFLTEQERVTSNEVSTGNSPKSVSPLPIKFGNRGMYKKERKFHKVTSMGDECIDTRGKDGHFGEIQPIRRSISMDSSVDRQLYLAVQEEISRRNRQIPVAGDGEDSSSSGGGNSRVMKRCFFSFGSSRTSKSSSILPVYLEP

SEQ ID NO: 1538 - DNA, 1146 bp, Arabidopsis thaliana; identical to SEQ ID NO: 1536
  G1095 Genomic Sequence

SEQ ID NO: 1539 - DNA, 1146 bp, Arabidopsis thaliana; identical to SEQ ID NO: 1536
  G1095 DNA sequence used for BLAST

SEQ ID NO: 1540 - DNA, 1137 bp, Arabidopsis thaliana
  G1099 cDNA Sequence
atggcgatcctcgacacaaagtccagccgttggatcccacacaaccttctctttcttctcctcttgctcttgctccagtcagtaccgtatggattcggtcagactcagaccacaccacccggaacaacaaaaacgaaacctaacgatccagttgttgttgtaatcacggttttgtttttagtgatctttttcatggtcttcggttccatcttctgtcgtcgaagcaacgcacagttttcacgttcttccattttccgatccaccgacgcagacgccgagtctcaggtcgtcaggatcaggaggttgacggcgcgtgggctcgacgcggaggctatagaaactttcccgacgtttctttactcggaggtgaaggcggtgaggatcgggaaaggtggtgtggagtgtgcggtttgtctctgtgaattcgaagacgacgaaacgctgcgtttgatgcctccttgttgccacgtgtttcacgccgattgtgttgacgtctggctctcagaacactccacgtgtcctctctgtagagcggatcttgtcctaaaccaacaaggtgacgacgacgacagcactgaaagctactcgggtacggatccaggtacgatttcgtcgagtacggatcctgagagaggaatggttttggaatcttcggacgcgcatttgctggatgctgtgacgtggagcaatagtaacataacacctcggtcaaagtcaacggggttatccagctggcaaataaccggaattttgttcccgagatcgcactcgaccggacattcgttaattcaaccggctgggaatctagaccggtttacgttgaggttaccggatgatgtacgacggcaacttatgaagacatcgaggacgatgggacacgtggcgttactacctcaggcgaggagttcacggagcggttatagaagcggtagcgtcgggagcgagagaagcgctttcccgtacggacgtaagagtaataataacaatcgacggcttcattcgctgtctttttcattctctttccggagtggttccgtacggtctactttctccggagatgcgccgaagaatcttccgacatcgattgaagctggtgaacggtctttcgaacggctccgaccagatgaacgagtgtaa

SEQ ID NO: 1541 - protein, 378 aa, Arabidopsis thaliana
  G1099 Amino Acid Sequence
MAILDTKSSRWIPHNLLFLLLLLLLQSVPYGFGQTQTTPPGTTKTKPNDPVVVVITVLFLVIFFMVFGSIFCRRSNAQFSRSSIFRSTDADAESQVVRIRRLTARGLDAEAIETFPTFLYSEVKAVRIGKGGVECAVCLCEFEDDETLRLMPPCCHVFHADCVDVWLSEHSTCPLCRADLVLNQQGDDDDSTESYSGTDPGTISSSTDPERGMVLESSDAHLLDAVTWSNSNITPRSKSTGLSSWQITGILFPRSHSTGHSLIQPAGNLDRFTLRLPDDVRRQLMKTSRTMGHVALLPQARSSRSGYRSGSVGSERSAFPYGRKSNNNNRRLHSLSFSFSFRSGSVRSTFSGDAPKNLPTSIEAGERSFERLRPDERV

SEQ ID NO: 1542 - DNA, 1137 bp, Arabidopsis thaliana; identical to SEQ ID NO: 1540
  G1099 Genomic Sequence

SEQ ID NO: 1543 - DNA, 1137 bp, Arabidopsis thaliana
  G1099 DNA sequence used for BLAST
ttacactcgttcatctggtcggagccgttcgaaagaccgttcaccagcttcaatcgatgtcggaagattcttcggcgcatctccggagaaagtagaccgtacggaaccactccggaaagagaatgaaaaagacagcgaatgaagccgtcgattgttattattactcttacgtccgtacgggaaagcgcttctctcgctcccgacgctaccgcttctataaccgctccgtgaactcctcgcctgaggtagtaacgccacgtgtcccatcgtcctcgatgtcttcataagttgccgtcgtacatcatccggtaacctcaacgtaaaccggtctagattcccagccggttgaattaacgaatgtccggtcgagtgcgatctcgggaacaaaattccggttatttgccagctggataaccccgttgactttgaccgaggtgttatgttactattgctccacgtcacagcatccagcaaatgcgcgtccgaagattccaaaaccattcctctctcaggatccgtactcgacgaaatcgtacctggatccgtacccgagtagctttcagtgctgtcgtcgtcgtcaccttgttggtttaggacaagatccgctctacagagaggacacgtggagtgttctgagagccagacgtcaacacaatcggcgtgaaacacgtggcaacaaggaggcatcaaacgcagcgtttcgtcgtcttcgaattcacagagacaaaccgcacactccacaccacctttcccgatcctcaccgccttcacctccgagtaaagaaacgtcgggaaagtttctatagcctccgcgtcgagcccacgcgccgtcaacctcctgatcctgacgacctgagactcggcgtctgcgtcggtggatcggaaaatggaagaacgtgaaaactgtgcgttgcttcgacgacagaagatggaaccgaagaccatgaaaaagatcactaaaaacaaaaccgtgattacaacaacaactggatcgttaggtttcgtttttgttgttccgggtggtgtggtctgagtctgaccgaatccatacggtactgactggagcaagagcaagaggagaagaaagagaaggttgtgtgggatccaacggctggactttgtgtcgaggatcgccat

SEQ ID NO: 1544 - DNA, 909 bp, Arabidopsis thaliana
  G1100 cDNA Sequence
atggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtag

SEQ ID NO: 1545 - protein, 302 aa, Arabidopsis thaliana
  G1100 Amino Acid Sequence
MVQPGTEIKASDLTLLVITIILFAIFIVGLASVCFRWTSRQFYSQESINPFTDSDVESRTSITAVRGLDEAIINSFPTFLYSEVKERRIGIGGVECAVCICEFEDHETLRLMPECCHVFHADCVSVWLSDHSTCPLCRVDLCLQPGERSYLNPEPDLVESTNSHLFDGVTWTNRNRPSRSWSTRLSQCRVSQILISRSHSTGHSVVQPLDNLDRFTLRLPEEVRRQLTKKTVDNVAFSQARSSRRGYRSRSAGSERSVFSYQRRMHSFSDCAWSTSCGGEAVAPSKDSRRISVEQSQLDDRV

SEQ ID NO: 1546 - DNA, 909 bp, Arabidopsis thaliana; identical to SEQ ID NO: 1544
  G1100 Genomic Sequence

SEQ ID NO: 1547 - DNA, 909 bp, Arabidopsis thaliana
  G1100 DNA sequence used for BLAST
ctacactcgatcatctagctgggattgttcaactgatattcggcgggaatcctttgacggagccaccgcttctccgccacaggaggtggaccatgcacaatcagagaaggaatgcatccgccgttggtacgagaagacactcctctcgcttccggcacttctgcttctgtaaccacgccgtgagctcctagcctgagaaaatgccacgttgtccaccgtttttttcgtcagttgcctccggacttcttctggtaaccgaagcgtaaaccggtctaaattatctagcggttgaaccacagaatgtccggtcgaatgcgatctcgagattaatatctgggagactcgacattgagacaatctcgttgaccatgaccgagacggtctgttcctattggtccacgtcacaccatcaaacaaatgcgagtttgtagattctacaagatccggttccggattcaagtagcttctctcacccggttgtaagcaaagatccacacgacagagtggacacgtggagtgatcagagagccagacacttacacaatcagcatgaaacacgtggcagcattcaggcatcaaacggagcgtttcatggtcttcgaactcacagatacacactgcacactcgacgccacctatcccgattctccgctccttcacctccgagtagagaaacgtcggaaatgagttgatgatagcctcgtcgagcccacgcaccgccgtaatactcgtacgggattcaacgtcggagtcagtgaaagggttgatggattcttgtgagtaaaattggcgagaggtccagcggaagcaaaccgaagccaagccaacgatgaagattgcgaagagtataatcgtgattactagtagggttaggtcgcttgcttttatctcggttccaggctgcaccat

SEQ ID NO: 1548 - DNA, 1035 bp, Arabidopsis thaliana
  G1107 cDNA Sequence
atggtgaatccagttattggtgccgagatcaaatgccccttttgccaaagcgggtttgtcgaggaaatgagccgtgagattaatggcggcagcagtagcagtctaagggaggttcaagaccctgagattgattttggtacagaccgtgcattgtctctatggggtccaatcttgcttggaatgatgagtaatcctcgtagacgtagaaggtttaggaggacagagtttggtgtggataatgatgaggtcaatgtatctgatgatgttgatggaaatgacagcgtcgatattgatcgacatcatcatcgtcgtcatcgccacaggcaacaaggtagagagattgatttagacagagagtttgagtctatccttaggaggagacggagaagctcagctactatattgcagttgcttcagggtattcgtgcagggattgcttctgagtatgagagctcggatcgagacctgttaaatcaatcagctgttgttcagggttcaacgagtttgaatcaaaaccggaacaatacttctctttctgcaattggagattactttgttggatccagtttagaccatttgcttgaacatctagctgataatgattcaatcaggcacgggagtcttccagcacgtaaagaagttgtggataatctcccaacggttaagataagtgaatcattgcagtgctcgatttgtttggatgattttgacaaaggaagtgaagctaaagagatgccgtgtaagcacaagtttcacatccggtgtatagtaccgtggctcgagcttcacagttcatgtcccgtgtgccgatatgaactccctcctgatgatgagaccaaggttaatcctgtaagaccgagaacaagaactctagagatcaacgtaagtaatgagaatgtggaagatgatgcaaggaacagtaatgtgagcgagagaaggttctcttttccatggccgttcagcggattattctcttcatcctcttcgtcatccgcatcggcctcggggtcatctcatctcggtgagaactcgtaa

SEQ ID NO: 1549 - protein, 344 aa, Arabidopsis thaliana
  G1107 Amino Acid Sequence
MVNPVIGAEIKCPFCQSGFVEEMSREINGGSSSSLREVQDPEIDFGTDRALSLWGPILLGMMSNPRRRRRFRRTEFGVDNDEVNVSDDVDGNDSVDIDRHHHRRHRHRQQGREIDLDREFESILRRRRRSSATILQLLQGIRAGIASEYESSDRDLLNQSAVVQGSTSLNQNRNNTSLSAIGDYFVGSSLDHLLEHLADNDSIRHGSLPARKEVVDNLPTVKISESLQCSICLDDFDKGSEAKEMPCKHKFHIRCIVPWLELHSSCPVCRYELPPDDETKVNPVRPRTRTLEINVSNENVEDDARNSNVSERRFSFPWPFSGLFSSSSSSSASASGSSHLGENS

SEQ ID NO: 1550 - DNA, 1035 bp, Arabidopsis thaliana; identical to SEQ ID NO: 1548
  G1107 Genomic Sequence

SEQ ID NO: 1551 - DNA, 1036 bp, Arabidopsis thaliana
  G1107 DNA sequence used for BLAST
atggtgaatccagttattggtgccgagatcaaatgccccttttgccaaagcgggtttgtcgaggaaatgagccgtgagattaatggcggcagcagtagcagtctaagggaggttcaagaccctgagattgattttggtacagaccgtgcattgtctctatggggtccaatcttgcttggaatgatgagtaatcctcgtagacgtagaaggtttaggaggacagagtttggtgtggataatgatgaggtcaatgtatctgatgatgttgatggaaatgacagcgtcgatattgatcgacatcatcatcgtcgtcatcgccacaggcaacaaggtagagagattgatttagacagagagtttgagtctatccttaggaggagacggagaagctcagctactatattgcagttgcttcagggtattcgtgcagggattgcttctgagtatgagagctcggatcgagacctgttaaatcaatcagctgttgttcagggttcaacgagtttgaatcaaaaccggaacaatacttctctttctgcaattggagattactttgttggatccagtttagaccatttgcttgaacatctagctgataatgattcaatcaggcacgggagtcttccagcacgtaaagaagttgtggataatctcccaacggttaagataagtgaatcattgcagtgctcgatttgtttggatgattttgacaaaggaagtgaagctaaagagatgccgtgtaagcacaagtttcacatccggtgtatagtaccgtggctcgagcttcacagttcatgtcccgtgtgccgatatgaactccctcctgatgatgagaccaaggttaatcctgtaagaccgagaacaagaactctagagatcaacgtaagtaatgagaatgtggaagatgatgcaaggaacagtaatgtgagcgagagaaggttctcttttccatggccgttcagcggattattctcttcatcctcttcgtcatccgcatcggcctcggggtcatctcatctcggtgagaactcgtaaa

SEQ ID NO: 1552 - DNA, 725 bp, Arabidopsis thaliana
  G1109 cDNA Sequence
atgggttgctgctgttgtctcccgagtatacccgaagtaaagcctctacgtctttcttgtttgcagcctttttgggttttggtttttgttttcttatgttttattgttttctgtagagctcaagaactatagatgagcatcttcccttatctcgtgccacgccttcctctctctctaatgcatacagttcacctctttcgccgcctattcctttagccatcacgaatataaatcttcaaactagtccaccgaaattgccaagaactcagggcaattcgagtgaagcatccccgggactcacacaagttgttccagagaagaaaacatggcatgttgatgatctaactgattttgagctaaagaaacagtatcgagaagcaatcgatgaatgtccaatttgcttagaaggtattttgtttatcattcaaagttacatgttaaatataacattttggtaaatatcttcatcttgtttgtttgcagaatatgagattgataacccgaaattgctcactaaatgtggccatgactttcatctcgcttgcattcttgcatggatggaaagaagcgaggcgtgtccagtttgcgataaggtttgtgtccgtttaaaatccgccattttcacaatacattttgaacttcttgagtcactagaatctgttttgacaatagagtctactttttgggtattcttttcacaggaattagtgctcactgaatcataa

SEQ ID NO: 1553 - protein, 189 aa, Arabidopsis thaliana
  G1109 Amino Acid Sequence
MGCCCCLPSIPESSRTIDEHLPLSRATPSSLSNAYSSPLSPPIPLAITNINLQTSPPKLPRTQGNSSEASPGLTQVVPEKKTWHVDDLTDFELKKQYREAIDECPICLEEYEIDNPKLLTKCGHDFHLACILAWMERSEACPVCDKVCVRLKSAIFTIHFELLESLESVLTIESTFWVFFSQELVLTES

SEQ ID NO: 1554 - DNA, 725 bp, Arabidopsis thaliana; identical to SEQ ID NO: 1552
  G1109 Genomic Sequence

SEQ ID NO: 1555 - DNA, 725 bp, Arabidopsis thaliana
  G1109 DNA sequence used for BLAST
ttatgattcagtgagcactaattcctgtgaaaagaatacccaaaaagtagactctattgtcaaaacagattctagtgactcaagaagttcaaaatgtattgtgaaaatggcggattttaaacggacacaaaccttatcgcaaactggacacgcctcgcttctttccatccatgcaagaatgcaagcgagatgaaagtcatggccacatttagtgagcaatttcgggttatcaatctcatattctgcaaacaaacaagatgaagatatttaccaaaatgttatatttaacatgtaactttgaatgataaacaaaataccttctaagcaaattggacattcatcgattgcttctcgatactgtttctttagctcaaaatcagttagatcatcaacatgccatgttttcttctctggaacaacttgtgtgagtcccggggatgcttcactcgaattgccctgagttcttggcaatttcggtggactagtttgaagatttatattcgtgatggctaaaggaataggcggcgaaagaggtgaactgtatgcattagagagagaggaaggcgtggcacgagataagggaagatgctcatctatagttcttgagctctacagaaaacaataaaacataagaaaacaaaaaccaaaacccaaaaaggctgcaaacaagaaagacgtagaggctttacttcgggtatactcgggagacaacagcagcaacccat

SEQ ID NO: 1556 - DNA, 1309 bp, Arabidopsis thaliana
  G1130 cDNA Sequence
tcgactcacttctcacaagacttccaactaacaatcttcttaattaagattaatctcttaattaagacgcttagttaacaaaacatataaaaatggaagccatgggagaatggagcaacaacctcggaggaatgtacacttatgcaaccgaggaagccgatttcatgaaccagcttctcgcctcttatgatcatcctggcaccggctcatcctccggcgcagcagccagtggtgaccaccaaggcttgtattggaaccttggttctcatcacaaccaccttagcctcgtgtctgaagccggtagcttctgtttctctcaagagagcagcagctacagcgctgggaacagcggatattacaccgttgttccacccacggttgaagagaaccaaaatgagacaatggactttgggatggaagatgtgaccatcaatacaaactcataccttgttggtgaggagacaagtgagtgtgacgttgagaaatactcttctggaaagactcttatgcctttggaaaccgtagtggagaaccacgatgacgaggaaagcttgttgcaatctgagatctctgtgactactacaaaatctctcaccggctccaaaaagagatcccgtgccacatctactgataaaaacaagagagcaagagtgaataagagggcccagaagaacgtagagatgagtggggataacaatgaaggagaagaggaagaaggagagacgaagttgaagaaaagaaagaatggggcaatgatgagtagacagaactcaagcaccactttctgtacggaggaagaatcaaactgcgctgatcaagacggtggaggagaagactcatcctctaaggaagatgatccctcaaaggccctcaacctcaatggtaaaacaagagccagtcgtggtgcagccaccgatcctcaaagcctctatgcaaggaaaagaagagaaaggattaacgagagactaaggattttacaaaatctcgtccccaatggaacaaaggtcgatattagtacaatgcttgaggaagcagttcattacgtcaaatttttgcagctccaaattaagttattgagctctgatgatctatggatgtatgcgccgattgctttcaatgggatggacattggtctcagctcaccgagatgaagcagaaaacttgtgattttagttggatattttctcttatatataaccaaaaatgtaatattctttttcttttttaatattctccgccttcggacgagttcgattataaattctcgtacgatgttcaaatatgagagaaatggagagtcacgttcgat

SEQ ID NO: 1557 - protein, 352 aa, Arabidopsis thaliana
  G1130 Amino Acid Sequence
MEAMGEWSNNLGGMYTYATEEADFMNQLLASYDHPGTGSSSGAAASGDHQGLYWNLGSHHNHLSLVSEAGSFCFSQESSSYSAGNSGYYTVVPPTVEENQNETMDFGMEDVTINTNSYLVGEETSECDVEKYSSGKTLMPLETVVENHDDEESLLQSEISVTTTKSLTGSKKRSRATSTDKNKRARVNKRAQKNVEMSGDNNEGEEEEGETKLKKRKNGAMMSRQNSSTTFCTEEESNCADQDGGGEDSSSKEDDPSKALNLNGKTRASRGAATDPQSLYARKRRERINERLRILQNLVPNGTKVDISTMLEEAVHYVKFLQLQIKLLSSDDLWMYAPIAFNGMDIGLSSPR

SEQ ID NO: 1558 - DNA, 1487 bp, Arabidopsis thaliana
  G1130 Genomic Sequence
tcatctcggtgagctgagaccaatgtccatcccattgaaagcaatcggcgcatacatccatagatcatcagagctcaataactgcgtaattatattttaaaatattagttagatcatattcatataacaattgaacgtacaaaaaaaaaacgatttgtatttaaaacccttgcttaccttaatttggagctgcaaaaatttgacgtaatgaactgcttcctcaagcattgtactaatatcgacctgttacgtatttaagcaattgtaaatgtttagaatctttattaacaatttcttgtataattaatgaatttgcatgtaaaagagccatatcttctgcatgtttaaacgtttgcatgagtttttttttttacctttgttccattggggacgagattttgtaaaatccttagtctctcgttaatcctttctcttcttttctgcacgacaaaaaaataataaaaaaccaaattaattttttgaaacataatcttccataaaaatttgatattttatcttttttgtgggaaacaaacaaagcaatttacccttgcatagaggctttgaggatcggtggctgcaccacgactggctcttgttttaccattgaggttgagggcctttgagggatcatcttccttagaggatgagtcttctcctccaccgtcttgatcagcgcagtttgattcttcctccgtacagaaagtggtgcttgagttctgtctactcatcattgccccattctttcttttcttcaacttcgtctctccttcttcctcttctccttcattgttatccccactcatctctacgttcttctgggccctcttattcactcttgctctcttgtttttctgagtccatggcaaaccgtttctatattagtcactaaaccaaatgtgatctctctagctaattgccaaccagttcgaaaattaaagacttacatcagtagatgtggcacgggatctctttttggagccggtgagagattttgtagtagtcacagagatctcagattgcaacaagctttcctcgtcatcgtggttctccactacggtttccaaaggcataagagtctttccagaagagtatttctcaacgtcacactcacttgtctcctcaccaacaaggtatgagtttgtattgatggtcacatcttccatcccaaagtccattgtctcattttggttctcttcaaccgtgggtggaacaacggtgtaatatccgctgttcccagcgctgtagctgctgctctcttgagagaaacagaagctaccggcttcagacacgaggctaaggtggttgtgatgagaaccaaggttccaatacaagccttggtggtcaccactggctgctgcgccggaggatgagccggtgccaggatgatcataagaggcgagaagctggttcatgaaatcggcttcctcggttgcataagtgtacattcctccgaggttgttgctccattctcccatggcttccat

SEQ ID NO: 1559 - DNA, 1478 bp, Arabidopsis thaliana
  G1130 DNA sequence used for BLAST
tcatctcggtgagctgagaccaatgtccatcccattgaaagcaatcggcgcatacatccatagatcatcagagctcaataactgcgtaattatattttaaaatattagttagatcatattcatataacaattgaacgtacaaaaaaaaaacgatttgtatttaaaacccttgcttaccttaatttggagctgcaaaaatttgacgtaatgaactgcttcctcaagcattgtactaatatcgacctgttacgtatttaagcaattgtaaatgtttagaatctttattaacaatttcttgtataattaatgaatttgcatgtaaaagagccatatcttctgcatgtttaaacgtttgcatgagtttttttttttacctttgttccattggggacgagattttgtaaaatccttagtctctcgttaatcctttctcttcttttctgcacgacaaaaaaataataaaaaaccaaattaattttttgaaacataatcttccataaaaatttgatattttatcttttttgtgggaaacaaacaaagcaatttacccttgcatagaggctttgaggatcggtggctgcaccacgactggctcttgttttaccattgaggttgagggcctttgagggatcatcttccttagaggatgagtcttctcctccaccgtcttgatcagcgcagtttgattcttcctccgtacagaaagtggtgcttgagttctgtctactcatcattgccccattctttcttttcttcaacttcgtctctccttcttcctcttctccttcattgttatccccactcatctctacgttcttctgggccctcttattcactcttgctctcttgtttttctgagtccatggcaaaccgtttctatattagtcactaaaccaaatgtgatctctctagctaattgccaaccagttcgaaaattaaagacttacatcagtagatgtggcacgggatctctttttggagccggtgagagattttgtagtagtcacagagatctcagattgcaacaagctttcctcgtcatcgtggttctccactacggtttccaaaggcataagagtctttccagaagagtatttctcaacgtcacactcacttgtctcctcaccaacaaggtatgagtttgtattgatggtcacatcttccatcccaaagtccattgtctcattttggttctcttcaaccgtgggtggaacaacggtgtaatatccgctgttcccagcgctgtagctgctgctctcttgagagaaacagaagctaccggcttcagacacgaggctaaggtggttgtgatgagaaccaaggttccaatacaagccttggtggtcaccactggctgctgcgccggaggatgagccggtgccaggatgatcataagaggcgagaagctggttcatgaaatcggcttcctcggttgcataagtgtacattcctccgaggttgttgctccattctcccat

SEQ ID NO: 1560 - DNA, 1150 bp, Arabidopsis thaliana
  G1131 cDNA Sequence
tcgactcctctcctgattgcttcaccttcttctttactacaggtttcagctcctcaatgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactagttttagtttcaagcctgaagttctctatgcctaaatttgtgtctgttatcgttgttttgtcttcttagttagtgttttgtcttgttgatttaggggctaattatcctggttaatctcctcttaactgggaa

SEQ ID NO: 1561 - protein, 233 aa, Arabidopsis thaliana
  G1131 Amino Acid Sequence
MSMDCLSYFFNYDPPVQLQDCFIPEMDMIIPETDSFFFQSQPQLEFHQPLFQEEAPSQTHFDPFCDQFLSPQEIFLPNPKNEIFNETHDLDFFLPTPKRQRLVNSSYNCNTQNHFQSRNPNFFDPFGDTDFVPESCTFQEFRVPDFSLAFKVGRGDQDDSKKPTLSSQSIAARGRRRRIAEKTHELGKLIPGGNKLNTAEMFQAAAKYVKFLQSQVGILQLMQTTKKVITNPK

SEQ ID NO: 1562 - DNA, 702 bp, Arabidopsis thaliana
  G1131 Genomic Sequence
atgtccatggattgcttaagctacttctttaactacgatcctcctgtccagctccaggattgctttattcccgagatggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataa

SEQ ID NO: 1563 - DNA, 888 bp, Arabidopsis thaliana
  G1131 DNA sequence used for BLAST
atggatatgattatccctgaaaccgatagtttcttcttccaatctcaaccgcaactggagtttcatcagccattgtttcaagaagaagctccttcacagacccactttgaccctttctgcgaccagtttctttctccgcaagaaatctttctccctaaccctaaaaacgaaatcttcaacgaaacacacgacctcgatttctttctccccacgccaaaacgccagagacttgttaactccagctacaattgtaacactcaaaaccatttccagagccgtaacccgaatttcttcgaccctttcggcgacactgatttcgttccagaatcttgtaccttccaggagtttcgagttccggatttctctttagctttcaaggtaggccggggagatcaagatgactcaaagaaaccgacgctttcatctcagagcatcgcggctagagggaggagaagaagaattgcagagaagactcacgagctcggaaaactcatccccggtggcaataaacttaacaccgccgagatgttccaagccgccgctaagtatgtcaagtttttgcagagtcaagttgggattctccaactgatgcagaccacaaagaaggtaataaccaaccccaaataagaactttatcatccaattgaaactctaatcgtgttttctcacaagcttcttaatttgtttacgcagggtagctctaatgtgcaaatggaaactcagtatttgcttgaatcgcaagcaatccaggagaagttatcaacagaggaagtgtgtttggtaccgtgtgaaatggttcaagatctaacaactgaagaaaccatttgcagaaccccgaatatttctcgagaaatcaacaagttactgtctaaacatctggctaactag

SEQ ID NO: 1564 - DNA, 1322 bp, Arabidopsis thaliana; identical to SEQ ID NO: 81
  G1133 cDNA Sequence

SEQ ID NO: 1565 - protein, 326 aa, Arabidopsis thaliana
  G1133 Amino Acid Sequence
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 1566 - DNA, 981 bp, Arabidopsis thaliana
  G1133 DNA sequence used for BLAST
tcaccaatggttattcaaaccctttgatgagtttaagctttgcttcagcaacttgaggtaatcaatggcttcgtctagtagtaaaagagcttcttttccctttgcccctggaactacactctccaggattctcagagcggtgtgaatcttgtcttttcttgactgctcgtcgctcaaaccagaacccgtttcttgtttgcttgaaatgtttgattcaggaaggttttcatctgataagcctttgactttagtggtgcccacaagggatggtgatgagtctctgtacgaatggtccagtagtttctgtcttttaagaagtggaccatcaacagtgctttcagtttcatccagctcttctgttgttatgttgcacgcttgttgttcaactgtgaatggagagtgaccagtgctcattacttcatcatcactttcccaatcatcattatcgtcatcatcagaatacagtaacgcgttgatttcctcagtgtcttcgtgcatttccgagtcttcttcgccattttcatgatcttcatgttgcaatatcttttcttgaatggcatgatctttactaaaccctttctctgggtgtagggcaccgagaatgttccctcgctctgcatccatagaagaaggaaaccgcagaggaaatccacattgtaacaaacgagtctgctctcccgactgatcgaatactataaatcttttccgagaagacttgagtgccccctctggagcagcaccgttgctagatcgcccattcaaacatgaaacttgttttccacaagactgctgatcatatctagacaataaggcttggaacggtggctgcaaatagcgaaactgatgctcagctgcataaactttaccgagttccggaaaaggaattccaggacggaaatactcagtcgccttgtcctggacacaagcttgaggatttaagcctaatggcaaccatttctgctgtttggtatcaagaggcat

SEQ ID NO: 1567 - DNA, 1064 bp, Arabidopsis thaliana
  G1134 cDNA Sequence
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 1568 - protein, 262 aa, Arabidopsis thaliana
  G1134 Amino Acid Sequence
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 1569 - DNA, 1988 bp, Arabidopsis thaliana
  G1134 Genomic Sequence
ttattgttcttccttaggtatgcatgtgcacctcttctgttcttctgttaactcctatattatccacaccaaaataaaccaactcataactctttttactatatactgttgactaatcatttttaattcatctattgggttcctctaaaaggttttgtgtgtatatatattaacttagataatttacctggatctgcctttgaagaactttcacgtattctactgcttcttctaacatgtctgcagtgttggtttgctgcaacaaagacaaaaaagttaaccgatatactcaaagcctagattccaaatctccatatataccaaaaccaaaagttttcctcagtttgttcataatctatagagaggaaaccaagttcatacttatttgatcgaggtgacaacaattcaagtccatatcaagatccattccacagtttgtgaattacttagttacagagctgagaaccgtgtctctgaagttgcatcacaaccattaacagtcatatttaatttgacctctaacttctacacttgatttaagcatagataatctttgacctatttctagtcaatataattgtgtaaccgaggtcatcagattatacctaagctgaaaattatattaccttgtccatgttaggtacaagctcttgtagcttccttatccgatcactaatccgcgtccttcgtacctacacaatgaaaggtaaagataaatatacactgaccagaacagaacaatcctctgttcaatgaagcatacagtgcatcattaaacatccgtaaattgaaagtaaagatataagttgtatcactaaacttcaatgtataaagttaagagaaccttgatcactacacttccaaaacattgaaaataaagattgaatgttgtttaccctctcggcaatgctgcggggatgagttgcgcaaccacgtttagcccgaaccctaaaagcaacagagtcctccataaggttctccatgttcatatccgacatgcttgatactccggtaggaacttgaccgctgctttgctctcctttctacttacagaaaaaaattccaaaaagcgcaaatcagcactaataccttaatcaacacataggtaacacatatgttcccaaaattttgatcaagtgtagttacttaatactaagtagaccaatgtaccaaaaggtgtggagaatcaatacatttgtacacattaaccaccgaagtatgtatcatcatgtggacttatggtcttctaaacactttacccataggagcattctttaatgttcacattgacacattaaagccacagagccaacaacaaaaactgccatttttttttttttgagttaaaatagaaactgcaacttgcttagtttggttcagaaaaacacaagttgtcaattttaagacaagactggtcttttcaatctcgagaacttggtcagcaaattaactaaaacaagtaataagtcagttaagttcatcctatttttggcaagtataagaaaaccctaatttaagaactaattttggtttaccatttgagaagtaaactcaggagaagagaagagtgcttccatttctctagaccgcttacttcccggagaaacatcgatattccccgataagtaatcgtaattcgcctgaatcccaaagctttggataaatccatcagaaccactaagaaaatccgccggagtactattctgtcggtgaaacccaccttgttgatacaacccttgctcaacaggaatcgggaactcgaacgagccgcgacttgtcggtaaatcgttcgagttcccggtaagcaaatcggtgagaccaagattaggtttcaaagactcttcttcatcttcctcaagtaaagcttcaagccaagtcgctggagctgaacggatccgagatagtccacttctacttagccctcctcctcctcctctgcctcctccgtcgtcaccaccgccgctactaccgacggatgttggttgcat

SEQ ID NO: 1570 - DNA, 1988 bp, Arabidopsis thaliana; identical to SEQ ID NO: 1569
  G1134 DNA sequence used for BLAST

SEQ ID NO: 1571 - DNA, 1311 bp, Arabidopsis thaliana
  G1137 cDNA Sequence
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 1572 - protein, 348 aa, Arabidopsis thaliana
  G1137 Amino Acid Sequence
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 1573 - DNA, 1047 bp, Arabidopsis thaliana
  G1137 Genomic Sequence
atgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtga

SEQ ID NO: 1574 - DNA, 1044 bp, Arabidopsis thaliana
  G1137 DNA sequence used for BLAST
cgccttatctgtctgcagatttcttgttccccatgttgtctctttaagcaacaagattggtgacttgtgagtggtggagctttggttcttaacctctgtggagattaagtctcgtttcagcaactttaggtaatcaattgcttcgtccagaagtaagagcgcttcgtttccttttgcaccagggactacgctctcgagtattttcagagctgtgcggatcttgtctttcttcgactgctcgttgctcagaccagaaccagtgtcctctttggtcgatatggtttttgattcagggagctttttgtccttaagaaaggaagatccattgagttgtgtggagctctcagtgcccacaagtgatgataagtcgctgatgttgttgaccttatccagtagtttctgccttttacaaggaccatcgatttcttctaattcccttttgttgcaaactccttcatttggataaggagagtgaccagtgctcattacttcatcatcactctcgcaatcatcatcataatcatcatctgaatatagcaatgcattgatctcctcagtgtcttcatgcatttctgactctgttccatcactcttgtgaaactcttcaccatcttctttgaaagctttctctataccttgtaactcagagagtttcactggttctgcagccgcatgagatggaaaccgtagaggaaatggacattgtaatagacgagtctggtctcctgactgatcgaatatcaaaagtcttttctgagaagactctaatgctccaagtggagtagtagtagtagtagcagcagcgcaccaagaccgcatgtcagaccgtgagaatctttttccataagactccttatcatgactgcacagcaaagactggaatggtggtggctgcaaacagcgagcctgaagcttagctgcatatagtttcccaagctcagggagaggaattctaggaaggacagaccgacctactatatccttgaagcaagcttgaggacttaagcccagaggcaaatcccgttgcctcttatccagaggcat

SEQ ID NO: 1575 - DNA, 1413 bp, Arabidopsis thaliana
  G1141 cDNA Sequence
gtctttacaaaaagaaaagaaaaaagagacgctagaaagaacgcgaaagcttgcgaagaagatttgcttttgatcgacttaacacgaacaacaaacaacatctgcgtgataaagaagagatttttgcctaaataaagaagagattcgactctaatcctggagttatcattcacgatagattcttagattgcgactataaagaagaagatggctgtatatgaacaaaccggaaccgagcagccgaagaaaaggaaatctagggctcgagcaggtggtttaacggtggctgataggctaaagaagtggaaagagtacaacgagattgttgaagcttcggctgttaaagaaggagagaaaccgaaacgcaaagttcctgcgaaagggtcgaagaaaggttgtatgaagggtaaaggaggaccagataattctcactgtagttttagaggagttagacaaaggatttggggtaaatgggttgcagagattcgagaaccgaaaataggaactagactttggcttggtacttttcctaccgcggaaaaagctgcttccgcttatgatgaagcggctaccgctatgtacggttcattggctcgtcttaacttccctcagtctgttgggtctgagtttactagtacgtctagtcaatctgaggtgtgtacggttgaaaataaggcggttgtttgtggtgatgtttgtgtgaagcatgaagatactgattgtgaatctaatccatttagtcagattttagatgttagagaagagtcttgtggaaccaggccggacagttgcacggttggacatcaagatatgaattcttcgctgaattacgatttgctgttagagtttgagcagcagtattggggccaagttttgcaggagaaagagaaaccgaagcaggaagaagaggagatacagcaacagcaacaggaacagcaacagcaacagctgcaaccggatttgcttactgttgcagattacggttggccttggtctaatgatattgtaaatgatcagacttcttgggatcctaatgagtgctttgatattaatgaactccttggagatttgaatgaacctggtccccatcagagccaagaccaaaaccacgtaaattctggtagttatgatttgcatccgcttcatctcgagccacacgatggtcacgagttcaatggtttgagttctctggatatttgagagttctgaggcaatggtcctacaagactacaacataatctttggattgatcataggagaaacaagaaataggtgttaatgatctgattcacaatgaaaaaatatttaataactctatagtttttgttctttccttggatcatgaactgttgcttctcatctattgagttaatatagcgaatagcagagtttctctcataaaaaaaaaaaaaa

SEQ ID NO: 1576 - protein, 330 aa, Arabidopsis thaliana
  G1141 Amino Acid Sequence
MAVYEQTGTEQPKKRKSRARAGGLTVADRLKKWKEYNEIVEASAVKEGEKPKRKVPAKGSKKGCMKGKGGPDNSHCSFRGVRQRIWGKWVAEIREPKIGTRLWLGTFPTAEKAASAYDEAATAMYGSLARLNFPQSVGSEFTSTSSQSEVCTVENKAVVCGDVCVKHEDTDCESNPFSQILDVREESCGTRPDSCTVGHQDMNSSLNYDLLLEFEQQYWGQVLQEKEKPKQEEEEIQQQQQEQQQQQLQPDLLTVADYGWPWSNDIVNDQTSWDPNECFDINELLGDLNEPGPHQSQDQNHVNSGSYDLHPLHLEPHDGHEFNGLSSLDI

SEQ ID NO: 1577 - DNA, 993 bp, Arabidopsis thaliana
  G1141 DNA sequence used for BLAST
tcaaatatccagagaactcaaaccattgaactcgtgaccatcgtgtggctcgagatgaagcggatgcaaatcataactaccagaatttacgtggttttggtcttggctctgatggggaccaggttcattcaaatctccaaggagttcattaatatcaaagcactcattaggatcccaagaagtctgatcatttacaatatcattagaccaaggccaaccgtaatctgcaacagtaagcaaatccggttgcagctgttgctgttgctgttcctgttgctgttgctgtatctcctcttcttcctgcttcggtttctctttctcctgcaaaacttggccccaatactgctgctcaaactctaacagcaaatcgtaattcagcgaagaattcatatcttgatgtccaaccgtgcaactgtccggcctggttccacaagactcttctctaacatctaaaatctgactaaatggattagattcacaatcagtatcttcatgcttcacacaaacatcaccacaaacaaccgccttattttcaaccgtacacacctcagattgactagacgtactagtaaactcagacccaacagactgagggaagttaagacgagccaatgaaccgtacatagcggtagccgcttcatcataagcggaagcagctttttccgcggtaggaaaagtaccaagccaaagtctagttcctattttcggttctcgaatctctgcaacccatttaccccaaatcctttgtctaactcctctaaaactacagtgagaattatctggtcctcctttacccttcatacaacctttcttcgaccctttcgcaggaactttgcgtttcggtttctctccttctttaacagccgaagcttcaacaatctcgttgtactctttccacttctttagcctatcagccaccgttaaaccacctgctcgagccctagatttccttttcttcggctgctcggttccggtttgttcatatacagccat

SEQ ID NO: 1578 - DNA, 2910 bp, Arabidopsis thaliana
  G1149 cDNA Sequence
atgtcaaatcgtggtggtggtggtcacggcggcgctagtcgtggtcgaggaggtggacgaaggtctgaccagagacaagatcagtcttctggtcaagttgcttggccgggtttacaacaaagctacggtggtcgtggtggttctgtttccgccggtagaggtcgtggaaacgtcggaagaggtgaaaatactggagatctgacggcgacgcaagttccggttgcttctgctgtttctggcgggagaggtcgtggtaacatcggagatccgacgttttctgttgcgtcttcgtctaagacggtgtctgttgcttcttcatctaaagaggaaagtaagaatacggaggtttctgagaccatgtcgaaccttcagattacttcgacggagacgaaacctgaaatgacgtcacttcctccggcgtcatctaaagcggttacgtttccggtacggccaggacgtggtactttggggaagaaagtcatggttcgtgcgaatcatttccttgttcaagttgctgatcgtgatctctaccattacgatgtttcgatcaatcctgaggttatatcaaagacagtgaacagaaacgtgatgaaacttctggttaagaattataaagactctcacttgggagggaagtcaccagcgtatgatggaaggaaaagcctctatactgctggtccattaccttttgactcgaaagagtttgttgtgaatctggcggagaaaagagctgacggttcctctgggaaggacagaccgtttaaagttgctgtaaagaatgtgacaagcactgatctttatcagttgcaacagttccttgatcgtaagcaaagagaggctccatatgatactatccaagtgcttgatgttgttcttagggataagccctctaatgattatgtctctgttgggaggtcttttttccacactagtttgggaaaggacgcaagagatggtaggggtgagcttggagatggtattgagtactggagaggttatttccaaagtctaaggctgactcagatgggtttgtctctgaacattgacgtttcagcaagatcattttatgaaccgattgttgtcactgactttattagcaagtttctgaatataagggacttaaacaggccacttagagactcagatcgacttaaggtgaagaaagttttgaggacactgaaagttaagttgcttcactggaacggcacaaaaagtgccaaaattagtgggatttctagtctacccatcagggagctaaggttcactctggaggacaaatcagagaagacggttgttcaatattttgctgaaaaatataattatagagtgaaataccaggctctacctgctattcaaacagggagtgacacaagacccgtctacctaccaatggagctctgccaaattgacgaagggcaaagatacaccaaaaggctcaatgagaagcaagtgactgcattgctaaaagctacctgccaacgaccccctgatagagagaactcgatcaaaaacttggttgtgaaaaataattacaatgatgatctgagcaaggagtttgggatgtcagtgactacccaactagcctcgattgaagctcgtgtacttcccccaccgatgttgaagtaccatgacagtggtaaagagaaaatggtaaatccaaggctaggacagtggaacatgattgacaagaaaatggttaatggagcaaaagtcacttcttggacttgcgaatttaagcctcaacctgctattccgttcatctcttgtccccctgaacatattgaggaagctcttctcgatatccacaaaagggcacctggtctccaactgttgattgtaatattgcctgatgtgactggatcatatggaaaaataaaaaggatctgtgaaacagaattggggattgtctctcagtgttgccaacctagacaagttaataaactcaacaagcagtacatggaaaatgttgccttgaagatcaatgtcaagactgggggaaggaacactgttcttaatgatgctattagaagaaacatacctcttattactgatcgtccaaccatcatcatgggtgctgatgtgactcacccacagcctggagaggactcaagtccttctattgctgctgttgtggcctctatggactggcctgagataaacaaataccgaggattggtttctgctcaagctcatagggaagaaattattcaggacctgtataagctggttcaggatccacaacgtgggctagtccactctggtttgataagggaacatttcatagcattcaggagagctacaggccagatacctcaaaggatcatcttctatcgtgacggagtaagcgaagggcagtttagtcaggttctgctacatgagatgactgctatccgcaaggcttgtaactctctccaagagaattatgttcctcgtgttactttcgtgattgtccagaaacgtcaccacacacgtttgttccctgagcaacacgggaatcgtgatatgactgataagagtggcaatattcaaccaggtactgtcgtggacactaaaatctgtcaccctaatgaattcgacttctatttgaacagccatgctggtattcagggaacaagcaggccggcacattaccatgtacttctcgatgagaacggtttcaccgctgatcagttgcaaatgctcacaaacaacctctgctacacgtatgcgaggtgtacaaaatctgtgtcaattgtgccaccagcctactacgctcacttggctgcattccgtgcccgctactacatggagagtgagatgtctgatggaggttcgagcaggtccaggagctcaacaacaggtgtgggtcaagtcatttcgcagctcccagcaataaaagataacgtcaaggaggttatgttttattgctaa

SEQ ID NO: 1579 - protein, 969 aa, Arabidopsis thaliana
  G1149 Amino Acid Sequence
MSNRGGGGHGGASRGRGGGRRSDQRQDQSSGQVAWPGLQQSYGGRGGSVSAGRGRGNVGRGENTGDLTATQVPVASAVSGGRGRGNIGDPTFSVASSSKTVSVASSSKEESKNTEVSETMSNLQITSTETKPEMTSLPPASSKAVTFPVRPGRGTLGKKVMVRANHFLVQVADRDLYHYDVSINPEVISKTVNRNVMKLLVKNYKDSHLGGKSPAYDGRKSLYTAGPLPFDSKEFVVNLAEKRADGSSGKDRPFKVAVKNVTSTDLYQLQQFLDRKQREAPYDTIQVLDVVLRDKPSNDYVSVGRSFFHTSLGKDARDGRGELGDGIEYWRGYFQSLRLTQMGLSLNIDVSARSFYEPIVVTDFISKFLNIRDLNRPLRDSDRLKVKKVLRTLKVKLLHWNGTKSAKISGISSLPIRELRFTLEDKSEKTVVQYFAEKYNYRVKYQALPAIQTGSDTRPVYLPMELCQIDEGQRYTKRLNEKQVTALLKATCQRPPDRENSIKNLVVKNNYNDDLSKEFGMSVTTQLASIEARVLPPPMLKYHDSGKEKMVNPRLGQWNMIDKKMVNGAKVTSWTCEFKPQPAIPFISCPPEHIEEALLDIHKRAPGLQLLIVILPDVTGSYGKIKRICETELGIVSQCCQPRQVNKLNKQYMENVALKINVKTGGRNTVLNDAIRRNIPLITDRPTIIMGADVTHPQPGEDSSPSIAAVVASMDWPEINKYRGLVSAQAHREEIIQDLYKLVQDPQRGLVHSGLIREHFIAFRRATGQIPQRIIFYRDGVSEGQFSQVLLHEMTAIRKACNSLQENYVPRVTFVIVQKRHHTRLFPEQHGNRDMTDKSGNIQPGTVVDTKICHPNEFDFYLNSHAGIQGTSRPAHYHVLLDENGFTADQLQMLTNNLCYTYARCTKSVSIVPPAYYAHLAAFRARYYMESEMSDGGSSRSRSSTTGVGQVISQLPAIKDNVKEVMFYC

SEQ ID NO: 1580 - DNA, 5225 bp, Arabidopsis thaliana
  G1149 Genomic Sequence
ttagcaataaaacataacctccttgacgttatcttttattgctgggagctgcgaaatgacttgacccacacctgttgttgagctcctggacctgctcgaacctccatcagacatctcactctccatgtagtagcgggcacggaatgcagccaagtgagcgtagtaggctggtggcacaattgacacagattttgtacacctcgcatacctgcatatgcattttattatatgttttgttagtttcagagagttaaaacatgtcataaggaaaatgtacaatgttgttgtctcttacgtgtagcagaggttgtttgtgagcatttgcaactgatcagcggtgaaaccgttctcatcgagaagtacatggtaatgtgccggcctgcttgttccctattaccattcaaacattcaaaggaagttgtaattctgctgagacaaaacaggtcataaattggtctagattctggaagcaatacctgaataccagcatggctgttcaaatagaagtcgaattcattagggtgacagattttagtgtccacgacagtacctgataaggaaatacaaatatgttacttgaaatctggatcattaaaggaattaagttgatagagaagagcagagagtgagaaacctggttgaatattgccactcttatcagtcatatcacgattcccgtgttgctcagggaacaaacgtgtgtggtgacgtttctggacaatcacgaaagtaacacgaggaacataattctcttggagagagttacaagccttgcggatagcagtcatctcatgtagcagaacctgactaaactgcccttcgcttactccgtcactgtataaagagaaagcaattagccaaacctgctcatgctatgaaatgtttaagcatggaatgtgagaaccacttaccgatagaagatgatcctttgaggtatctggcctgtagctctcctgaatgctatgaaatgttccctgcaatcacaaacagtgtccattatatttattcttgtgaaaaatcaaagaacacaagaagttgtagatgttttgctcttaccttatcaaaccagagtggactagcccacgttgtggatcctgaaccagcttatacaggtcctgaataatttcttccctatgagcttgagcagaaaccaatcctcggtatttgtttatctcaggccagtccatagaggccacaacctgtagttgaaataagagaattaccttttatgatgaaacagtagtataatgagatacaagtaaaataagatatacatacagcagcaatagaaggacttgagtcctctccaggctgtgggtgagtcacatcagcacccatgatgatggttggacgatcagtaataagaggtatgtttcttctaatagcatcattaagaacagtgttccttcccccagtctgtaatacaaatacccgttttacaccatcataaaaaacaataagaagcacagatgactagaccttgacattgatcttcaaggcaacattttccatgtactgcttgttgagtttattaacttgtctaggttggcaacactgagagacaatccccaattctgtttcacagatcctttttatttttcctgcagacagaaagagtacttcatgaacagattgtcggaataaactttgcaccaaatattaccaatcattagcacagacttaccatatgatccagtcacatcaggcaatattacaatcaacagttggagaccaggtgcccttttgtggatatcgagaagagcttcctcaatatgttcagggggacaagagatgaacggaatagcaggttgaggcttaaattcctggcacaaagaattaaaacaaaaaaaagagttagtaaattttttggtatgaaattgtgacaagtatcaataagcatgagacaagacagaccattcctttgctgacacacatcccaatcaactgtttgcagaactcttggggtaaaccacggtcaatccgagtagagaaacttacgcaagtccaagaagtgacttttgctccattaaccattttctggaccatatcacagccaaaaggaggtaagagccccaaaatttggtaacacacattaaaccacaatagaagcattaaacacaaatcttcatcactaactatttcttccgcatccacacgcaaagcagtaaagtatagtataatttatcattataagagaaatagaagcatatttcttatttagtttcaagtgcctacagagagcaaaaagattatgatagtcaattacagttttaccttgtcaatcatgttccactgtcctagccttggatttaccattttctctttaccactgtcatggtacttcaactgttaacagaaagaacatcgtgatgagcaacattgacaagaaaatgcatgataataaagcaaattaataacaaaaatggagaaagaaaatcaccatcggtgggggaagtacacgagcttcaatcgaggctagttgggtagtcactgacatcccaaactccttgctcagatcatcattgtaattatttttcacaaccaactaataatataaacaacaaacgtgatgttagtcaaaacagaggtgcaaaattaaagactatttttccgatggaggaactactgtatatgtaatgtaaagaggactaaacctacgtttttgatcgagttctctctatcagggggtcgttggcaggtagcttttagcaatgcagtcacttgcttctcattgagccttttggtgtatctttgcccttcgtcaatttggcagagctgcaagaaccaggaataaccagatctttaaggatacaaaatgaatccaagaaaacgatggaggtaaaaaagtagatgttattaaaaatatacctccattggtaggtagacgggtcttgtgtcactccctgtttgaatagcaggtagagcctggtatttcactctataattatatttttcagcaaaatattgaacaaccgtcttctctgatttgtcctccagagtgaacctgaaatgattagaacataggcaacatcagcaaatttataaccaaagatcagaaacctcttccaagaaaagcaagaaaacaaagttcaacgattatgcaccctgctaaagtaagcatcttcaccttagctccctgatgggtagactagaaatcccactaattttggcactttttgtgccgttccagtgaagcaacttaactttcagtgtcctcaaaactttcttcacctaaataccaacatatgattttcaagataagaatcatatataagacatcatcttgaataatattaataattaaaatggtggaatataagtcagatatataccttaagtcgatctgagtctctaagtggcctgtttaagtcccttatattcagaaacttgctaataaagtcagtgacaacaatcggttcataaaatgatcttgctgaaacgtctgcatcataagaaaacaacacggctataatgaatcaaaatcatctgcagttaaaaccataaagtagaattattcaattctaaatcaaataaaaatataagaattaatcaacatcaccaatccagataacattaagcatattcttaccaatgttcagagacaaacccatctgagtcagccttagactttggaaataacctctccagtactcaataccatctccaagctcacccctaccatctcttgcgtcctttcccaaactagtgtggaaaaaagacctcccaacagagacataactgaacagaaagcaaaacagggaaatgttaagtttatgcatagcttttgacaatactgaagtttatgcaaatttcagatttcttactcattagagggcttatccctaagaacaacatcaagcacttggatagtatcatatggagcctctctttgcttacgatcaaggaactgttgcaactgataaagatcagtgcttgtcacattctttacagcaactttaaacggtctgtccttcctgccaaaaggagtcacaatgccaaaaaaaactatgaaaaacaaggcgatacaaacacattcacaaagagttaaaacaagacattacccagaggaaccgtcagctcttttctccgccagattcacaacaaactctttcgagtcaaaaggtaatggaccagcagtatagaggcttttccttccatcatacgctggtgacttccctcccaagtgagagtctttataattcttaaccagaagtttcatcacgtttctgttcactgtctttgatataacctcaggattgatcgaaacctataacacaataacaataacttttagccaaaaaatctctatatgactaaaacaagtcacaaccgcagattcatcatgtcaaaactctctctaggaactttgtgaaatacatcagatcaacaataaaaaggaacaaacaacagtatattcgtcgaatgaaagcaaaaaaaaaaaaaaaccaatgatgcagaaactaacaaattttcagtcagaaatctcactgaaagaacaacttcagatgaacacaaacgacaaaaaaaagttcatcttttgacgtacaaggtttacaaaaactgaacaacaacaaaaagcaaaaaacactataacttgatgaaatagaaacgacaatatttgaaatcgacacataaaaacgacaaacaagtacagattcgtcgagaaaaaatggccggaaacttacatcgtaatggtagagatcacgatcagcaacttgaacaaggaaatgattcgcacgaaccatgactttcttccccaaagtaccacgtcctggccgtaccggaaacgtaaccgctttagatgacgccggaggaagtgacgtcatttcaggtttcgtctccgtcgaagtaatctgaaggttcgacatggtctcagaaacctccgtattcttactttcctctttagatgaagaagcaacagacaccgtcttagacgaagacgcaacagaaaacgtcggatctccgatgttaccacgacctctcccgccagaaacagcagaagcaaccggaacttgcgtcgccgtcagatctccagtattttcacctcttccgacgtttccacgacctctaccggcggaaacagaaccaccacgaccaccgtagctttgttgtaaacccggccaagcaacttgaccagaagactgatcttgtctctggtcagaccttcgtccacctcctcgaccacgactagcgccgccgtgaccaccaccaccacgatttgacat

SEQ ID NO: 1581 - DNA, 5225 bp, Arabidopsis thaliana; identical to SEQ ID NO: 1580
  G1149 DNA sequence used for BLAST

SEQ ID NO: 1582 - DNA, 1247 bp, Arabidopsis thaliana
  G1181 cDNA Sequence
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttccttttttgaccaaaa

SEQ ID NO: 1583 - protein, 299 aa, Arabidopsis thaliana
  G1181 Amino Acid Sequence
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 1584 - DNA, 983 bp, Arabidopsis thaliana
  G1181 DNA sequence used for BLAST
atgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacgtacgtttataataatcatttcttcttcgattccttctatttccattgttcttgatttaatcaatcctcttttttattcacagggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaa

SEQ ID NO: 1585 - DNA, 2054 bp, Arabidopsis thaliana
  G1196 cDNA Sequence
catctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaaatggctgcaactgcaatagagccatcttcatctataagtttcacatcttctcacttatcaaacccttctcctgttgttactacttatcactcagctgctaatcttgaagagctcagctctaacttggagcagcttctcactaatccagattgcgattacactgacgcagagatcatcattgaagaagaagctaaccctcggaagcttcgtaactatgttgagaagtcactagtagagaatgttcttcctatcctcttagttgcgtttcattgtgatttgacacagcttcttgatcaatgcattgagagagtggcgagatcagacttagacagattctgtatcgaaaaggagcttcctttagaagtattggaaaaaatcaaacagcttcgagttaagtcggtgaacatacccgaggtggaggataaatcgatagagagaacagggaaagtactcaaggcattggattcagatgatgtagaactcgtgaagcttcttttgactgagtcagatataactctagaccaagccaatggtctacattatgcagtggcatacagtgatccgaaagttgtgacacaggttcttgatctagatatggctgatgttaatttcagaaattccagggggtatacggttcttcatattgctgctatgcgtagagagccaacaattatcataccacttattcaaaaaggagctaatgcttcagatttcacgtttgatggacgcagtgcggtaaatatatgtaggagactcactaggccgaaagattatcataccaaaacctcaaggaaagaacctagtaaataccgcttatgcatcgatatcttggaaagggaaattagaaggaatccattggttagtggggatacacccacttgttcccattcgatgcccgaggatctccaaatgaggttgttatacttagaaaagcgagtgggacttgctcagttgttcttcccagcagaagccaatgtggctatggacgttgctaatgttgaagggacaagcgagtgcacaggtcttctaactccacctccatcaaatgatacaactgaaaacttgggtaaagtcgatttaaatgaaacgccttatgtgcaaacgaaaagaatgcttacacgtatgaaagccctcatgaaaacagttgagacaggtcggagatacttcccatcttgttatgaggttctggataagtacatggatcagtatatggacgaagaaatccctgatatgtcgtatcccgagaaaggcactgtgaaagagagaagacagaagaggatgagatataacgagctgaagaacgacgttaaaaaagcatatagcaaagacaaagtcgcgcggtcttgtctttcttcttcatcaccagcttcttctcttagagaagccttagagaatccaacatgatcttgtcccagataagtaatgctactagagatagttccttggaagaaattagctattttataggttttggtttagaaaacagtggagatcccattttggtattcaggtttattacatggtttaggtttgattttgtattaaaggagatggatttttgaaatgtataaagcaaaacctttcctttttgctttgcttctttctttaaaaaaaaaattgtaatatatggaagtgaaatcgaagcaacgattgagcaaaaaaaaa

SEQ ID NO: 1586 - protein, 467 aa, Arabidopsis thaliana
  G1196 Amino Acid Sequence
MAATAIEPSSSISFTSSHLSNPSPVVTTYHSAANLEELSSNLEQLLTNPDCDYTDAEIIIEEEANPRKLRNYVEKSLVENVLPILLVAFHCDLTQLLDQCIERVARSDLDRFCIEKELPLEVLEKIKQLRVKSVNIPEVEDKSIERTGKVLKALDSDDVELVKLLLTESDITLDQANGLHYAVAYSDPKVVTQVLDLDMADVNFRNSRGYTVLHIAAMRREPTIIIPLIQKGANASDFTFDGRSAVNICRRLTRPKDYHTKTSRKEPSKYRLCIDILEREIRRNPLVSGDTPTCSHSMPEDLQMRLLYLEKRVGLAQLFFPAEANVAMDVANVEGTSECTGLLTPPPSNDTTENLGKVDLNETPYVQTKRMLTRMKALMKTVETGRRYFPSCYEVLDKYMDQYMDEEIPDMSYPEKGTVKERRQKRMRYNELKNDVKKAYSKDKVARSCLSSSSPASSLREALENPT

SEQ ID NO: 1587 - DNA, 1978 bp, Arabidopsis thaliana
  G1196 DNA sequence used for BLAST
tcatgttggattctctaaggcttctctaagagaagaagctggtgatgaagaagaaagacaagaccgcgcgactttgtctttgctatatgcttttttaacgtcgttcttcagctcgttatatctcatcctcttctgtcttctctctttcacagtgcctttctcgggatacgacatatcagggatttcttcgtccatatactgatccatgtacttatccagaacctcataacaagatgggaagtatctccgacctgtctcaactgcgttgttgaacggtttcgaatcagtcaatcttgtggtcagagaataaaacttgaaagtacatttccttaagcttttacctgttttcatgagggctttcatacgtgtaagcattcttttcgtttgcacataaggcgtttcatttaaatcgactttacccaagttttcagttgtatcatttgatggaggtggagttagaagacctgtgcactcgcttgtcccttcaacattagcaacgtccatagccacattggcttctgctgggaagaacaactgagcaagtcccactgcaatgacacatacaagaattcaataaagagacatcaaccttaagctatgagaaatatatatatcgactaggtcaatacctcgcttttctaagtataacaacctcatttggagatcctcgggcatcgaatgggaacaagtgggtgtatccccactaaccaatggattccttctaatttccctttccaagatatcgatgcataagcggtatttactaggttctttccttgaggttttggtatgataatctttcggcctagtgagtctcctacatatatttaccgcactgcgtccatcaaacgtgaaatctgaagcattagctcctttttgaataagtggtatgataattgttggctctctacgcatagcagcaatatgaagaaccgtataccccctggaatttctgaaattaacatcagccatatctagatcaagaacctgtgtcacaactttcggatcactgtatgccactgcataatgtagaccattggcttggtctagagttatatctgactcagtcaaaagaagcttcacgagttctacatcatctgaatccaatgccttgagtactttccctgttctctctatcgatttatcctccacctcgggtatgttcaccgacttaactcgaagctgtttgattttttccaatacttctaaaggaagctccttttcgatacagaatctgtctaagtctgatctcgccactctctcaatgcattgatcaagaagctgtgtcaaatcacaatgaaacgcaactaagaggataggaagaacattctctactagtgacttctcaacatagttacgaagcttccgctgcagacacaacaacacacaacattacagccttgaccaatcaagaacagattatttaccagcaaaatcacaaagaaactttatctcaaacctgaaatgacgaaacaagatccgggatttggaacacaaatgaagcatacatcaactcaacagcaaaatcaatggccggtttacaagaatcatgagcacaaactgaatcaacacaagttgaaacctcgataggaaaaggctttaacctcccagtgtagatatagctcaagaaatgcagaaatgcctcacgtcccacatttccatatggtaataaatctttcatttgatacttaggtttcttctcactactatctttatctttcttaaacagatcaagaaaaaacttgctcctagcagctaaaacacatctatgaacactcacagggttagcttcttcttcaatgatgatctctgcgtcagtgtaatcgcaatctggattagtgagaagctgctccaagttagagctgagctcttcaagattagcagctgagtgataagtagtaacaacaggagaagggtttgataagtgagaagatgtgaaacttatagatgaagatggctctattgcagttgcagccat

SEQ ID NO: 1588 - DNA, 1071 bp, Arabidopsis thaliana
  G1197 cDNA Sequence
cagccgagaaaataaaagaaacgaagaaaagtttgttcctttgtggggatcaaagaagaatgtactcggcgattcggtcttcgcttcctctagatggcagcttgggagactactctgacggaaccaatcttcccatcgacgcttgtctggtcctaaccactgaccccaagcctcgccttcgttggacctctgagctccatgaaagattcgttgacgccgtcactcagctcggcggacccgacaaagcaacgcctaaaactataatgagaacaatgggagtgaagggtctcactctttaccatctcaaatctcatcttcagaaattccgcttggggaggcaatcttgtaaagaatcaattgacaactctaaggatgtttcttgtgttgcggagagtcaggacactggttcatcttcaacatcatccttaagattggctgctcaagaacagaacgagagttaccaggtcactgaagctttgcgtgcccagatggaagtccaaagaagactacacgagcaactagaggtgcaaaggcgactccagttaaggatcgaggcacaagggaagtacctgcaatcaattctagagaaagcttgcaaggctatagaggagcaagctgttgcatttgctgggttagaggcagctagagaagagctttcagagctagccataaaggcctccatcaccaatgggtgccaaggaacaacaagcaccttcgacacaaccaaaatgatgattccatccttatccgagcttgcagtagcaatagagcacaagaacaactgttcagcagagagctctctgacttccagcactgtaggaagtccggtatcagctgcgttgatgaagaagagacaacgaggagtgtttggaaatggagatagtgtggttgttggtcatgatgctggatgggttatgcctagtagtagcattggatgaagttagcaagagagagagagagagcgagaccagattttagcttatttaattttgctatgttgtatttaactctaaactctgtcatcaaacttgtcttagcgtctatgtatatatttgttgaatctaaaaaaaa

SEQ ID NO: 1589 - protein, 292 aa, Arabidopsis thaliana
  G1197 Amino Acid Sequence
MYSAIRSSLPLDGSLGDYSDGTNLPIDACLVLTTDPKPRLRWTSELHERFVDAVTQLGGPDKATPKTIMRTMGVKGLTLYHLKSHLQKFRLGRQSCKESIDNSKDVSCVAESQDTGSSSTSSLRLAAQEQNESYQVTEALRAQMEVQRRLHEQLEVQRRLQLRIEAQGKYLQSILEKACKAIEEQAVAFAGLEAAREELSELAIKASITNGCQGTTSTFDTTKMMIPSLSELAVAIEHKNNCSAESSLTSSTVGSPVSAALMKKRQRGVFGNGDSVVVGHDAGWVMPSSSIG

SEQ ID NO: 1590 - DNA, 1634 bp, Arabidopsis thaliana
  G1197 Genomic Sequence
tcatccaatgctactactaggcataacccatccagcatcatgaccaacaaccacactatctccatttccaaacactcctcgttgtctcttcttcatcaacgcagctgataccggacttcctacagtgctggaagtcagagagctctctgctgaacagttgttcttgtgctctattgctactgcaagctcggataaggatggaatcatcattttggttgtgtcgaaggtgcttgttgttccttggcacccattggtgatggaggcctttatggctagctctgaaagctcttctctagctgcctctaacccagcaaatgcaacagcttgctcctctatagccttgcaagctttctctagaattgattgcaggtacttcccttgtgcctcgatccttaactggagtcgcctttgcacctgcgtatactaatggatcttattaaatgtggaaccagggctcaaacattagtatatgcggtttctatggttctaactttcatgaaaagatttcctaagtagtaacgttctgataagctttaaggaaattcaatggaggtttctatatagtctctcattaaccaaagtctctctggtatttggtgaattcgaagaagaaactaacctctagttgctcgtgtagtcttctttggacttccatctgggcacgcaaagcttcagtgacctggtaactcctggctcaagacaaaaacaatgagtgttatagacagtgaatataacacttggaataaagagaacacttgaaaccatactcgttctgttcttgagcagccaatcttaaggatgatgttgaagatgaaccagtgtcctgactctccgcaacacaagaaactacagagatataagttcacaaagatataaatgcacaactgaatccataaagatataaatggattcttagctaaagatataactgaataccatccttagagttgtcaattgattctttacaagattgcctccccaagcggaatttctaccgagcaaaaaaccagagaacaacacagtcaaaaagcaatgaactttgtttgttataagtagccaaagaagcataatttgatattgaaggtagtagcatcaaaacctgaagatgagatttgagatggtaaagagtgagacccttcactcccattgttctcattatagttttaggcgttgcttctgacatcaaaccaaacacacaaaaaaactaatcttgtaaacaaatctcaaggccaataaaaaaaacctaaagaatgccacagtaattcctaaattgttctaagtgacataaacccaagaaatccattctatttcaggatgattgacttccaaatctgaaagaaattagacctaactcgttgtcaaattcttcgtactaactgaagaacaacagattaaaaaaaaaaacacatttcattctaagatccataaatttctaagaagggacacttactgtcgggtccgccgagctgagtgacggcgtcaacgaatctttcatggagctcagaggtccaacgaaggcgaggcttggggtcagtggttaggaccagacaagcgtcgatgggaagattggttccgtcagagtagtctcccaagctgccatctagaggaagcgaagaccgaatcgccgagtacat

SEQ ID NO: 1591 - DNA, 1634 bp, Arabidopsis thaliana; identical to SEQ ID NO: 1590
  G1197 DNA sequence used for BLAST

SEQ ID NO: 1592 - DNA, 2127 bp, Arabidopsis thaliana
  G1202 cDNA Sequence
caaatcacatattttgtgaaatcccaaagaaagtttttgctttcaccggccagtcatgggaaactatcggtggccgtcaaagctatcaaagttatcactcagagcaaaacaaacgaatctgtaccgcgtcattctaatcgcgatcctctgcgtcaccttttacttcgtcggagtatggcaacactccggcagaggaatctcacgctcttccatttctaaccacgagctcacgtccgtgccctgcacgtttcctcaccaaaccacaccgattctcaacttcgcctcccgtcacacagcccctgaccttcctccgacgataacggacgcgcgtgttgttcaaatcccgtcgtgcggcgttgaattctcggagtacacgccctgcgagttcgtgaatcggtctttgaatttcccaagagagaggcttatatacagagagagacactgtccggaaaaacacgagatagtcaggtgtcggattccagcgccgtacggttacagtttaccttttcggtggccggagagccgtgacgtggcgtggtttgctaacgtgccgcatacggaactaacggtggagaagaagaatcagaactgggtaaggtatgagaaggataggtttttatttcctggtggtggtacgatgtttccacgtggagctgatgcttacatcgacgagatcggacggttgataaatctcaaagatggatcaattcggacagccattgatactggatgtggggtagcgagctttggggcgtatctaatgtcgaggaacatagtaacgatgtcgtttgcaccaagagacacacacgaagctcaggttcagttcgcacttgagagaggagtccctgccatcataggagtgttagcctctattaggctcccatttccggccagagccttcgacattgctcattgctctcgatgtctcattccttggggccaatacaacgggacgtatctcatagaagtggatagggtactgagaccgggggggtattggattttgtcgggaccgccgattaactggcagagacactggaagggttgggaaagaactagagacgatctcaactcggagcagtctcagatcgagagggtggctaggagcttgtgttggaggaaattggtgcagagagaggatcttgcggtttggcagaaacctaccaaccatgttcactgtaagcgcaatcggatagctttaggacgccctccgttctgccaccggacactacccaaccagggctggtacactaagcttgaaacctgtttgacgccgttgccggaagtaacaggatctgagatcaaagaagtagcgggtggacagttggcgagatggcctgagagattgaatgctcttcctccgaggatcaaaagtggaagcttggaagggatcactgaggatgaatttgtcagcaacacagagaaatggcagagaagagtgtcttactacaagaaatatgaccaacagctagcggagacgggaagatacagaaactttctcgacatgaacgctcatcttggaggtttcgcctcagccttagtcgatgatcctgtatgggtcatgaatgttgtccccgtggaggccagtgttaacacccttggagttatctatgagcgaggattgattggaacgtatcaaaactggtgtgaagcaatgtcaacttacccaaggacatacgatttcatccatgccgattcggtgttcagtctgtacaaagacagatgtgacatggaagatatcttgctagaaatggacaggattctaagaccaaagggaagcgtgatcatcagagacgacattgatgtgctaaccaaagtgaagaagattacagatgcgatgcaatgggaagggaggataggagatcatgaaaacggacctcttgaaagagagaagattttgtttcttgtgaaggagtactggaccgcacctgcgcctgatcagtcatcagatccttgatcaagcttggaataattcataaaatttgtagctccattcttttttcttcaaatgttttgtacacactaatcgactttgggggaaagaagaaacaaacacccgctaaattgtttcaaaccggagattcattgcgactttgtgagaaaatgaactagagagtttactacaaa

SEQ ID NO: 1593 - protein, 633 aa, Arabidopsis thaliana
  G1202 Amino Acid Sequence
MGNYRWPSKLSKLSLRAKQTNLYRVILIAILCVTFYFVGVWQHSGRGISRSSISNHELTSVPCTFPHQTTPILNFASRHTAPDLPPTITDARVVQIPSCGVEFSEYTPCEFVNRSLNFPRERLIYRERHCPEKHEIVRCRIPAPYGYSLPFRWPESRDVAWFANVPHTELTVEKKNQNWVRYEKDRFLFPGGGTMFPRGADAYIDEIGRLINLKDGSIRTAIDTGCGVASFGAYLMSRNIVTMSFAPRDTHEAQVQFALERGVPAIIGVLASIRLPFPARAFDIAHCSRCLIPWGQYNGTYLIEVDRVLRPGGYWILSGPPINWQRHWKGWERTRDDLNSEQSQIERVARSLCWRKLVQREDLAVWQKPTNHVHCKRNRIALGRPPFCHRTLPNQGWYTKLETCLTPLPEVTGSEIKEVAGGQLARWPERLNALPPRIKSGSLEGITEDEFVSNTEKWQRRVSYYKKYDQQLAETGRYRNFLDMNAHLGGFASALVDDPVWVMNVVPVEASVNTLGVIYERGLIGTYQNWCEAMSTYPRTYDFIHADSVFSLYKDRCDMEDILLEMDRILRPKGSVIIRDDIDVLTKVKKITDAMQWEGRIGDHENGPLEREKILFLVKEYWTAPAPDQSSDP

SEQ ID NO: 1594 - DNA, 3103 bp, Arabidopsis thaliana
  G1202 DNA sequence used for BLAST
atgggaaactatcggtggccgtcaaagctatcaaagttatcactcagagcaaaacaaacgaatctgtaccgcgtcattctaatcgcgatcctctgcgtcaccttttacttcgtcggagtatggcaacactccggcagaggaatctcacgctcttccatttctaaccacgagctcacgtccgtgccctgcacgtttcctcaccaaaccacaccgattctcaacttcgcctcccgtcacacagcccctgaccttcctccgacgataacggacgcgcgtgttgttcaaatcccgtcgtgcggcgttgaattctcggagtacacgccctgcgagttcgtgaatcggtctttgaatttcccaagagagaggcttatatacagagagagacactgtccggaaaaacacgagatagtcaggtgtcggattccagcgccgtacggttacagtttaccttttcggtggccggagagccgtgacgtggcgtggtttgctaacgtgccgcatacggaactaacggtggagaagaagaatcagaactgggtaaggtatgagaaggataggtttttatttcctggtggtggtacgatgtttccacgtggagctgatgcttacatcgacgagatcggacggttgataaatctcaaagatggatcaattcggacagccattgatactggatgtggggtaagttaagacttcagatcactctgttttgttccttgttgattttgtttctttgtactattcatgtgatgtctgtgtttttttttggctctcttgttaatgttaccatgcttgtgtgatgtcatacattttgattttttttctctgattctttgacatttacgcctcatatttatttttgcaagtatgtgattatttgttttgggttatggagtgtgtttagtggaactagttgtatacattttgatgattgtgcaattacattgaaatcatctattgatgtttcctttgttcatagatttatgcaaatatgtataaactattctatttatcaattgatctaggtcaaagcagagaaatttatttccaatttcgcctgtgataccctattaattagatgtatactatttaatttttgtaaggatgagaattttggtcagttgtgtaatttatgactagaagaatattctgacacagcagagtgagagtgatggataggattgtcttgatacgaaatttatagaatggaaagtcacaagtagataaaaatcaataggatcaaaactagaaacgttttcctaattttctgtttctcttattggcaacgaataacaaattttgattttctatttttattgtataatcaggctgtaatgttttttatcagtaccttttaatcccaacaagtaattaaattgcattacagctaagtaaatgctggtttagactttagagtcatcagatagaaaatgtggatttcttagcatcgatagtttcaatcttcatatggaagtaaagtggtcaaaagacttttaaactgttttttttgtcttattgatgtaaatgggtaaatttaattctagcgtttacgatcataggttatgtaaatttatcgactgtctctaaagtctaaactaatgatgctaataggtagcgagctttggggcgtatctaatgtcgaggaacatagtaacgatgtcgtttgcaccaagagacacacacgaagctcaggttcagttcgcacttgagagaggagtccctgccatcataggagtgttagcctctattaggctcccatttccggccagagccttcgacattgctcattgctctcgatgtctcattccttggggccaatacagtaagttcacactcaccctctagtcacactctctttttttgcagctgttttgttatgtatgtgtgttttgactactgtttggtgtgagcagacgggacgtatctcatagaagtggatagggtactgagaccgggggggtattggattttgtcgggaccgccgattaactggcagagacactggaagggttgggaaagaactagagacgatctcaactcggagcagtctcagatcgagagggtggctaggagcttgtgttggaggaaattggtgcagagagaggatcttgcggtttggcagaaacctaccaaccatgttcactgtaagcgcaatcggatagctttaggacgccctccgttctgccaccggacactacccaaccagggctggtatataagattactagacaagaggagatggtcttactagaaaggaagattttatatttgactagatcatggtttgttctgttttgggttttcaggtacactaagcttgaaacctgtttgacgccgttgccggaagtaacaggatctgagatcaaagaagtagcgggtggacagttggcgagatggcctgagagattgaatgctcttcctccgaggatcaaaagtggaagcttggaagggatcactgaggatgaatttgtcagcaacacagagaaatggcagagaagagtgtcttactacaagaaatatgaccaacagctagcggagacgggaagatacagaaactttctcgacatgaacgctcatcttggaggtttcgcctcagccttagtcgatgatcctgtatgggtcatgaatgttgtccccgtggaggccagtgttaacacccttggagttatctatgagcgaggattgattggaacgtatcaaaactggtaaggttactattcctaataaccgaatacacatttttttgggaagcattcattgattcttttttatttcttaaactcttaacaggtgtgaagcaatgtcaacttacccaaggacatacgatttcatccatgccgattcggtgttcagtctgtacaaagacagatgtgacatggaagatatcttgctagaaatggacaggattctaagaccaaagggaagcgtgatcatcagagacgacattgatgtgctaaccaaagtgaagaagattacagatgcgatgcaatgggaagggaggataggagatcatgaaaacggacctcttgaaagagagaagattttgtttcttgtgaaggagtactggaccgcacctgcgcctgatcagtcatcagatccttga

SEQ ID NO: 1595 - DNA, 2694 bp, Arabidopsis thaliana
  G1207 cDNA Sequence
cgtcgacctagggttgtccaggaagaactcttctgtgtttgtttgatttgagctaatcagaaaggtgaaattgagaaaatggagggtgaagttgctactaacggagtgattctcaagcataatggtgtaaaggatatttctttagaaacttgttggccagagaagaagaaaccggttgaggcaacgagtcttagcagtggttcatcagacatagaagaagagattagtgtggaatgtcctaagcgagtggctaatcaaagacggaaacggtctaaagctgatgagattaaaacgaaatcttcaagaaagaggaaatgtgatgatgagaacaagtgtgaagagaatgagaagaagcagaggagctctgttaaaaagagagcaactacatggaaagaagaagaagttgttgttgatgatgaaaagaaatgcgaacaacaactccaactagttccttccagcaaggcaacatctcgaagcaggagcaagaaatcagtcagtgtggatacttggttggttaacaacgagattgatgttagcgctttgagttcgcgttctgagtctgaactttcggattcttatctgaaaaccgagtactttaatgactgcagaagcatgacaaggagtttaaaggcaaatttgggagagcttgcaatttgccatcaatgctctaaaggggaaagaagatatcttttcatttgcaccttttgtgaagtgaggttgtattgttttccatgcataaagaaatggtatccccatttgtccacggatgatatccttgaaaaatgtcccttttgccgaggaacttgcaactgctgcacatgtttgcactctagtggtttaatcgagacatctaagagaaagctcgataaatacgaaagattttatcatcttcgcttcttgattgtggcgatgcttcctttcctgaaaaagttatgcaaagcacaagatcaagaaatcgaaaccgaggctaaggttcaagattcaatggcttctcaagttgatatatccgagagtctatgctcaaatgaagagcgtgtcttctgtaaccactgtgcaacatcaattgttgacttgcatcgaagctgtccaaagtgttcatatgaattgtgtctgaactgttgccaagagatccgtggaggttggctttctgaccgcccggaatgtcagctacaattcgagtacagagggacccggtatatacatggcgaagctgcagaaccgagctcttcttctgtttccgaggatgaaactaaaactccatccatcaagtggaatgctgatgaaaatggaagcatacggtgtgcgccaaaagagctaggaggttgcggggactctgtgctggagcttaagcgaatcttaccagtgacttggatgtcagatttggagcaaaaggcagaaacattcttagcctcttatagtatcaaaccgccaatgtcatattgtagatgttcttctgatatgagtagtatgaagaggaaggcagcttcgagggacggatctagtgacaattacctttattctcctgattctttggatgtcctgaagcaagaagaacttctgcatttccaagagcattggtccaaaggtgaaccagtgattgttcgaaatgctcttaacaacacagctggtttaagctgggagccaatggtgatgtggcgggctttatgtgagaatgttgattcagcaattagctctaatatgtctgatgtcaaagctatcgattgtttagctaattgtgaggtgaagataaatactctatgtttctttgaaggatatagcaaaggaagaacatatgaaaacttctggcctgagatgctgaagctgaaggattggcctccttcagacaagtttgaaaaccttttacctcgtcactgcgatgagttcatttccgcattaccatttcaagaatacagcgatcctagatcaggaattctcaacattgctacaaaacttcctgaaggacttcttaaaccagatcttggtccaaaaacttatgttgcatatgggacttcagatgagctcggtagaggagattcagtcactaagcttcactgtgatatgtcagatgctgttaatattctgatgcatactgctgaagtaacactaagtgaggagcaaaggtctgcaattgcagatttgaaacagaaacataagcaacagaatgagaaagagcttcaggagcaaaatggtttagaggaagaagaggttatgagtgatgagattgtggtttatgatgaaacaagtggtgcactttgggacatctttaaaagagaagatgttcctaagcttgaagagtatctaaggaagcattgcatagaattcagacatacttattgctctcgtgttacaaaggtgtatcatccaatacatgatcagtcatatttcttaaccgtggagcataaaagaaaactcaaggcagaatttgggattgagccatggacatttgtgcaaaagctaggagaagcagtgtttattccagcaggttgtcctcatcaagttcggaatctcaagtcgtgcacaaaggtagctgttgattttgtttcccctgaaaacatcgatgagtgtctccgtttgactgatgagtttcgacaactccctaagaaccataaagccagagaagacaaacttgagataaaaaagatggtgatctatgcagttgaacaagcgcggccgctctagacaggcctcgtaccg

SEQ ID NO: 1596 - protein, 866 aa, Arabidopsis thaliana
  G1207 Amino Acid Sequence
MEGEVATNGVILKHNGVKDISLETCWPEKKKPVEATSLSSGSSDIEEEISVECPKRVANQRRKRSKADEIKTKSSRKRKCDDENKCEENEKKQRSSVKKRATTWKEEEVVVDDEKKCEQQLQLVPSSKATSRSRSKKSVSVDTWLVNNEIDVSALSSRSESELSDSYLKTEYFNDCRSMTRSLKANLGELAICHQCSKGERRYLFICTFCEVRLYCFPCIKKWYPHLSTDDILEKCPFCRGTCNCCTCLHSSGLIETSKRKLDKYERFYHLRFLIVAMLPFLKKLCKAQDQEIETEAKVQDSMASQVDISESLCSNEERVFCNHCATSIVDLHRSCPKCSYELCLNCCQEIRGGWLSDRPECQLQFEYRGTRYIHGEAAEPSSSSVSEDETKTPSIKWNADENGSIRCAPKELGGCGDSVLELKRILPVTWMSDLEQKAETFLASYSIKPPMSYCRCSSDMSSMKRKAASRDGSSDNYLYSPDSLDVLKQEELLHFQEHWSKGEPVIVRNALNNTAGLSWEPMVMWRALCENVDSAISSNMSDVKAIDCLANCEVKINTLCFFEGYSKGRTYENFWPEMLKLKDWPPSDKFENLLPRHCDEFISALPFQEYSDPRSGILNIATKLPEGLLKPDLGPKTYVAYGTSDELGRGDSVTKLHCDMSDAVNILMHTAEVTLSEEQRSAIADLKQKHKQQNEKELQEQNGLEEEEVMSDEIVVYDETSGALWDIFKREDVPKLEEYLRKHCIEFRHTYCSRVTKVYHPIHDQSYFLTVEHKRKLKAEFGIEPWTFVQKLGEAVFIPAGCPHQVRNLKSCTKVAVDFVSPENIDECLRLTDEFRQLPKNHKAREDKLEIKKMVIYAVEQARPL

SEQ ID NO: 1597 - DNA, 3564 bp, Arabidopsis thaliana
  G1207 DNA sequence used for BLAST
atggagggtgaagttgctactaacggagtgattctcaagcataatggtgtaaaggatatttctttagaaacttgttggccagagaagaagaaaccggttgaggcaacgagtcttagcagtggttcatcagacatagaagaagagattagtgtggaatgtcctaagcgagtggctaatcaaagacggaaacggtctaaagctgatgagattaaaacgaaatcttcaagaaagaggaaatgtgatgatgagaacaagtgtgaagagaatgagaagaagcagaggagctctgttaaaaagagagcaactacatggaaagaagaagaagttgttgttgatgatgaaaagaaatgcgaacaacaactccaactagttccttccagcaaggcaacatctcgaagcaggagcaagaaatcagtcagtgtggatacttggttggttaacaacgagattgatgttagcgctttgagttcgcgttctgagtctgaactttcggattcttatctgaaaaccgagtactttaatgactgcagaagcatgacaaggagtttaaaggtagcatttgttcttacacaatgagaaaacatcatgtgatgaaactgtattcaacttttttctgatttgttttcttccctacacaggcaaatttgggagagcttgcaatttgccatcaatgctctaaaggggaaagaagatatcttttcatttgcaccttttgtgaagtgaggttgtattgttttccatgcataaagaaatggttagtttctgttcttacattttaatgacactgcctataggtttcaatatcgtcaattacaatcttatgatttgtgacaggtatccccatttgtccacggatgatatccttgaaaaatgtcccttttgccgaggaacttgcaactgctgcacatgtttgcactctagtggtttaatcgaggtatgagttgcattcttaacaaaatatgtggtggttgtttatatagatcaagaaccgcaagttcgatttttgttttggtgtgaatagagatgtatctatttgtcttgcagacatctaagagaaagctcgataaatacgaaagattttatcatcttcgcttcttgattgtggcgatgcttcctttcctgaaaaagttatgcaaagcacaagatcaagaaatcgaaaccgaggctaaggttcaaggtatatatggttctcccttttactactaagacaagattttttcttgctacaagataacatattgatatgtttatagattcaatggcttctcaagttgatatatccgagagtctatgctcaaatgaagagcgtgtcttctggtaagtatcatccttttgttgcatgtgtttgaagagttacatgacatctatcttatatatcactgaaatgtctttgttgctctagtaaccactgtgcaacatcaattgttgacttgcatcgaagctgtccaaagtgttcatatgaattgtgtctgaactgttgccaagagatccgtggaggttggctttctgaccgcccggaatgtcagctacaattcgagtacagagggacccggtatatacatggcgaagctgcagaaccgagctcttcttctgtttccgaggatgaaactaaaactccatccatcaagtggaatgctgatgaaaatggaagcatacggtgtgcgccaaaagagctaggaggttgcggggactctgtgctggagcttaagcgaatcttaccagtgacttggatgtcagatttggagcaaaaggcagaaacattcttagcctcttatagtatcaaaccgccaatgtcatattgtagatgttcttctgatatgagtagtatgaagaggaaggcagcttcgagggacggatctagtgacaattacctttattctcctgattctttggatgtcctgaagcaagaagaacttctgcatttccaagagcattggtccaaaggtgaaccagtgattgttcgaaatgctcttaacaacacagctggtttaagctgggagccaatggtgatgtggcgggctttatgtgagaatgttgattcagcaattagctctaatatgtctgatgtcaaagctatcgattgtttagctaattgtgaggtagaaactcattttcttataaagtttctatagctgtataagaggttataaagctcattttgtttcttgttatttcaggtgaagataaatactctatgtttctttgaaggatatagcaaaggaagaacatatgaaaacttctggcctgagatgctgaagctgaaggattggcctccttcagacaagtttgaaaaccttttacctcgtcactgcgatgagttcatttccgcattaccatttcaagaatacagcgatcctagatcaggaattctcaacattgctacaaaacttcctgaaggacttcttaaaccagatcttggtccaaaaacttatgttgcatatgggacttcagatgagctcggtagaggagattcagtcactaagcttcactgtgatatgtcagatgctgtaagtttcagaattgttacttagtactgttaaataataatacggtttctcaggtgtataacggttttttgtttttgtaggttaatattctgatgcatactgctgaagtaacactaagtgaggagcaaaggtctgcaattgcagatttgaaacagaaacataagcaacagaatgagaaagagcttcaggagcaaaatggtttagaggaagaagaggttgtgagtgatgagattgtggtttatgatgaaacaagtggtgcactttgggacatctttaaaagagaagatgttcctaagcttgaagagtatctaaggaagcattgcatagaattcagacatacttattgctctcgtgttacaaaggtaagaaataatccacaaaacgttttcagttccgagtcttagaggttattgtgctgataggattctttatgttaggtgtatcatccaatacatgatcagtcatatttcttaaccgtggagcataaaagaaaactcaaggcagaatttggtatggttacttgtaactgtagtaactgtcacttaccgacattgtattcttacgtttttgtgtttgtttgtttgaactaaagggattgagccatggacatttgtgcaaaagctaggagaagcagtgtttattccagcaggttgtcctcatcaagttcggaatctcaaggttattatttgaatggaagctgtcctattaactaaactttttctcattatctttaacttgtattatggattttgatacagtcgtgcacaaaggtagctgttgattttgtttcccctgaaaacatcgatgagtgtctccgtttgactgatgagtttcgacaactccctaagaaccataaagccagagaagacaaacttgaggtgattctttttctgatattttcaattttggattagcaacttctgtcaatggatacagttttgtttgtagttgaatcttgttttaatctttgccatgtgaacagataaaaaagatggtgatctatgcagttgaacaagctctgaaagaagtggagacattattgctagatcgcagctaa

SEQ ID NO: 1598 - protein, 728 aa, Arabidopsis thaliana
  G1208 Amino Acid Sequence
MSENEIVPDEFRCNRSDGKQWRCKRRALEGKKMCESHHSQQSLKRSKQKVAESSKLVRSRRGGGDEVASSEIEPNESRIRSKRLGKSKRKRVMGEAEAMDEAVKKMKLKRGDLQLDLIRMVLKREVEKRKRLPNSNNKKKSNGGFSEFVGEELTRVLPNGIMAISPPSPTTSNVSSPCDVKVGEEPISMIKRRFRSKNIEPLPIGKMQDSQSVRSDIDRVLHLHYAVCMLLPVLKEINAEHKVEVENDAEKKVDLQRMCTRSSSVLRLNSDQDQSQESLSRKVGSVKCSNGIKSPKVLLDFHQNNLEHFQTHWSKGHPVIVRSVIKSGSSLNWDPVALFCHYLMNRNNKTGNTTDCMDWFEVEIGVKQFFLGSLRGKAETNTCQERLKLEGWLSSSLFKEQFPNHYAEILNILPISHYMDPKRGLLNIAANLPDTVQPPDFGPCLNISYRSGEEYAQPDSVKKLGFETCDMVDILLYVTETPVSTNQICRIRKLMKNIGRVRSKNPAKGRESRFDKGKKRDRLDDYSSSDSESSQHCLGAKCRGSEFEGEERESCNYSCEEESLSNTYGAQWDVFQKQDVSKLLEYIKNHSLELESMDSSKKKVSHPLLEQSYYLDEYHKARLKEEFDVEPWSFDQCVGEAVILPAGCPYQIRKNKSCVNAVLKFLSPEHVSESIKRVKELNQLPQSVKSKANKIEVKKMAIHKISEAVKEIRELTSSDSTGALRLYN

SEQ ID NO: 1599 - DNA, 4325 bp, Arabidopsis thaliana
  G1208 Genomic Sequence
ctagttatataatctcaatgcaccagttgaatccgaagatgtgagttcccgaatttcctttacagcttcgctgattttatgaatcgccattttcttcacctggatattgcagcaatatattattacataaacaccagacctttctaactcaaccttgtcttaacttttaaactaagggaacgtacctcaatcttatttgctttcgatttgacgctctgaggaagttgattgagctccttcactcgtttaatagattcgctaacgtgctcaggtgacagaaacttcagaaccgcatttacacaagactagcaaacatatgcaaaagttatgttaaaaagattcataactttgagattacaaaagaaggaaagagtgtgttgggtgctaaaagtaataccttattctttctaatttggtatggacatccagcagggaggatgactgcttccccaacacattgatcaaaactccatggttcaacgtctgaacaaacaaaataagcagcatgaatttgagtctgctgttcagacataatgaaatggaaagaaaaaagtagaagaaataaggatatgatacttaccaaattcttccttaagccttgctttgtgatactcatcaagatagtaactctgctcaagtaatggatgactcacctgccaaaatgatacataacagttaacaacaagggaacatcaacaattgatcttttgtagaagcaatcgaaccatcaacacataacttaccttttttttgctggaatccatggattctagctccagagagtggttcttaatatactcaagaagtttagaaacatcttgtttttggaatacatcccactgggcaccataagtgttgcttaggctctcttcttcacaagagtagttgcaactttctctttcctctccctcaaactcactgcctctgcatttagcgcctaaacagtgttgtgaagattctgaatcagaactggaatagtcatccaacctatctcgtttctttcccttatcaaatctgctttccctcccctttgccggatttttagatcttactcttccgatgtttttcattagctttcttatcctacaaatctggtttgtggatacaggtgtttctgtgacatataacaagatatcaacctgcagagcaaatcaaaaggtttagaaaaatataagtagatctgaaaagttaaacgagaaaagtcaaaaggatatttagctgaccactacttctttagctaacaatcagagtagatcttcaattcgtaaagctaggaaattgtgaaataaaggaaaactcttccaagaatggaagttctaagaaaacataccatgtcacaagtttcaaaacctaacttcttcacagaatcaggctgtgcatattcttcaccactcctgtatgaaatattgaggcatgggccaaaatcgggtggttgtacagtgtcaggtaggttggctgcaatatttagtagaccgcgctttggatccatgtaatgggagattggtaaaatattcagtatttcagcgtaatgatttgggaactgttctttaaacaatgaagatgaaagccatccctccagcttcagcctttcttgacaagtattagtctcagcctttcctctcaaagaccccaaaaaaaattgcttgacaccaatttctacctgttattgaataagaaacagaccaattaagagaccaaaggtattccaatccagaaagataagcaccagtaacatcacggaacacaagtcactaacctcaaaccaatccatacaatcagtagtattaccggttttgttgtttctgttcataagatagtgacagaacaaggctactggatcccaattcaggcttgaaccactctttatcacactacgaactattacaggatggcctttactccagtgtgtctgaaaatgttccagattgttttgatgaaaatccagcactgtggggtagtataagaagttaccagttccgtcttctcttgtcttggatgcttctttcaaatggctgtcgctactactagattgcgtttccattccaatacaaaatggacatcccgaatatttatctaaaatttcaggcaactcatagcaactgactacttcctctgcactgatctctaacttgcttgtcaactccagagggaatagactcaaaaaaaggttattgctgcaccctttgacttctttccgcttacacacttttggagattttataccattcgagcatttaaccgatccaacctttctagataagctctcttgactctgatcttggtcagaatttagcctgagaacagaggaactgcgtgtgcacattctttgcaaatccactacggcaaagtcacgaccattgctactgagacaaatattcaaagaatttgtcagagaaaaactcagagcaaatttacatcatatgcacacttaaggtagaataaggtagcaaagtgagaaccagggctgtcgatcgtcagaggttaattcagagctatggatttgtggttcagctggatttccctctatcacaaatgtgaaaaggaatcaaaagatatgagtgagtttaacttaacagaaccgaaggatccagcaaagaaagaatccgaataacagtctaattatggatatttcagtcctaaaaacaagaaaatcatcttaagatagaaagattaagatcaaatattaaacacctttcttttctgcgtcattttccacctccactttgtgttccgcattgatttcttttagtactggaagtagcatgcacaccgcataatgtagatgcaaaaccctgtcaatatcactcctgacactctgagaatcctggaacatattatagaagtaaacaagttcatgttacagaatatctgaagaatggaaaaaacatgtaaaattttaatgccaatgaattcttaagatagtcagaccttacattcagtgactccagaattagtgactgagcaaactttgcacctacatgacccacggcatacaggacattttttctcaacttcttctttcgatcccttgttcctaattaattccaagccaaaaaacagtttgatgactgcttctaaccaattagtagatcaaaatcaagcagcctaatagcaaaattttcgaaacagagaaattccagaagcaatctcaaaattgcaggaaagagtaccccatgctacatcctaaactttaagcaagatctccttaaaagtggaaagaaaatactctgtatggacataaacagaagaaatattgcaattaagtagttaccataggtgaatgaataaccctcaagatgtcttaggtccacaaaactactgaatgtttaaggagaactatcctcttcatgcaattagtaaactagatacagatgcttaaattctaatgagactatccatcagcaaaaaggccagagatgcaaacaaaataagtaaagcaaacataaccgacgataccttttctcgatacaatctatgcaaaagaactctctttcacaactcaaacaactaatcaaatccccaaatcctctggttccacaccaatgacacctcatcttcttttccttccttccattaaccaaatcacccttgaaaggaaccaccttgacaacaacaaaccaacaaaaccaaataaatagagtaaataaagaaacaaaatggatacacaaacacaaagtatcaaaattcaagctttcagttacctgcattttcccaattggcaaaggttcaatgttcttagacctaaacctccttttaatcatcgaaattggctcttccccaactttaacatcacaaggagaagacacattactagtagtaggagaaggtggagaaattgccataataccattaggaagaaccctcgttaactcttctccaacaaattcactaaaccctccattactcttcttcttattattactatttggtaatctcttcctcttctcaacttctctcttcaacaccatccttatcaaatccaactgcaaatctcctctcttcaacttcatcttcttcactgcttcatccatagcctctgcttcacccatcactctcttcctcttcgatttccccaatctcttagacctaattctgctttcgtttggctcgatctctgaagacgccacttcatctcctcctcctcttcttgatctgacaagcttagaagactctgcaactttctgcttacttcgctttaggctttgctgcgagtgatgactctcacacatctttttcccctctaaagctcgtctcttgcaccgccattgcttaccatcagagcggttgcaacgaaactcgtcagggacgatttcgttctccgacat

SEQ ID NO: 1600 - DNA, 4325 bp, Arabidopsis thaliana; identical to SEQ ID NO: 1599
  G1208 DNA sequence used for BLAST

SEQ ID NO: 1601 - DNA, 1972 bp, Arabidopsis thaliana
  G1218 cDNA Sequence
ctgtcgacttgctgcgagattgataaatgactagttaaagatttgaactttgatttctgggtttgcgattttattcaaatggagagatctagatccaagagaaactaccactatgaccaagactatgacggagattccatgcctaggtctaaacctcgctacaacaataattaccactttggtggtggcggcggaggaaataacagataccgtggcggcggcggtggtggaggtggaaatggccggccatcgaagtctcatcctgaaacgatggcaacaacgacttatcgaatcctctgtcacgacgctaaagcaggaggtgttattggtaaatccgggacaattatcaaatctataaggcaacacaccggcgcgtggattaacgtgcacgagctagttcctggagatgcagagcgtatcattgagatttctgataatcgtaggcgtgaccctgatgggagaatgccgtctttctctcctgctcaagaggctttgtttagtgttcatgacaggattttggagagtgaagctcagtttggttatggtggacctccgccggaagaggaggaggattacggtggagttagacctggtggagggagagttgtgactagattagtggtttctaggatgcatgttggttgtttgttgggtaaaggtgggaagattattgagcagatgaggattgaaactaagactcatattcggattcttccaagagaaagtaacttacctcgttgtgtttcactctctgaagagattgttcagattgtaggtgaactaaatgcagtgaaaaacgctttagccattgtatcatctcgtctaagggagagtcagcatcgtgatcggagtaatttccaagggcgttcacattcaccagaacggtcgtttgcagctgcgggggatgattacatgccacagctaagaagacaatcatccgataggtttcctcgtggtaattttagaaataacaacttcagttctcgccagtccaactatgcagaagaagctccagcagttccagttggtgagaatgtctactccgaagagcttgtgttccagattctctgcccagctgacaagattgttcgggttgttggggaatcgcaaggaataattgatttgcttcagaacgagatcggcgtggacgttagagtatctgacccagttgctggatctgatgaacagataatcaccatttcttcggaagaggcacctgatgatccatttttccctgctcaagaagccttgttgcacattcaaactcagatcatagatcttattccggataaagataatttaataccaacaagattacttgtcccatctagagactctatatgtttggaagggaaagcaggatcagtatctgagatatcacgattaactggaacaagcgtacaaattctagctagggaagaaattccccgatgtgcttctatcaatgatgttgttatacagattactggcgagatcagagctgctcgggaagcacttgttgaattaacattactattgaggagtcatatgttcaaggagctctctcaaaaggagacaccaccagcttccacatccacaactggccctctcgaaggtgttgcaggagtaatggaggtagcttcatcaaataacacaattcaatctcgtgaaggtcctactagttcgaatctgaacttgcagcaagttagcacaatcttgccacagtttaaggaaggtttcggatcagttgcaaaggcgggtgaaagtgaacaccgggaagaggttcctgtcacgacaagcagaatggcggtaccacttgttactagaagcactcttgaagttgtcttaccagaggcggttgttcctaagctcgttacgaaatcaagaaacaagcttgcacaaatcagtgagtggtctggagctagtgtaaccatagttgaagacagaccagaagaaacacagaatatcattcggcggccgctctagacaggcc

SEQ ID NO: 1602 - protein, 628 aa, Arabidopsis thaliana
  G1218 Amino Acid Sequence
MERSRSKRNYHYDQDYDGDSMPRSKPRYNNNYHFGGGGGGNNRYRGGGGGGGGNGRPSKSHPETMATTTYRILCHDAKAGGVIGKSGTIIKSIRQHTGAWINVHELVPGDAERIIEISDNRRRDPDGRMPSFSPAQEALFSVHDRILESEAQFGYGGPPPEEEEDYGGVRPGGGRVVTRLVVSRMHVGCLLGKGGKIIEQMRIETKTHIRILPRESNLPRCVSLSEEIVQIVGELNAVKNALAIVSSRLRESQHRDRSNFQGRSHSPERSFAAAGDDYMPQLRRQSSDRFPRGNFRNNNFSSRQSNYAEEAPAVPVGENVYSEELVFQILCPADKIVRVVGESQGIIDLLQNEIGVDVRVSDPVAGSDEQIITISSEEAPDDPFFPAQEALLHIQTQIIDLIPDKDNLIPTRLLVPSRDSICLEGKAGSVSEISRLTGTSVQILAREEIPRCASINDVVIQITGEIRAAREALVELTLLLRSHMFKELSQKETPPASTSTTGPLEGVAGVMEVASSNNTIQSREGPTSSNLNLQQVSTILPQFKEGFGSVAKAGESEHREEVPVTTSRMAVPLVTRSTLEVVLPEAVVPKLVTKSRNKLAQISEWSGASVTIVEDRPEETQNIIRRPL

SEQ ID NO: 1603 - DNA, 2843 bp, Arabidopsis thaliana
  G1218 DNA sequence used for BLAST
atggagagatctagatccaagagaaactaccactatgaccaagactatgacggagattccatgcctaggtctaaacctcgctacaacaataattaccactttggtggtggcggcggaggaaataacagataccgtggcggcggcggtggtggaggtggaaatggccggccatcgaagtctcatcctgaaacgatggcaacaacgacttatcgaatcctctgtcacgacgctaaagcaggaggtgttattggtaaatccgggacaattatcaaatctataaggcaacacaccggcgcgtggattaacgtgcacgagctagttcctggagatgcagagcgtatcattgagatttctgataatcgtaggcgtgaccctgatgggagaatgccgtctttctctcctgctcaagaggctttgtttagtgttcatgacaggattttggagagtgaagctcagtttggttatggtggacctccgccggaagaggaggaggattacggtggagttagacctggtggagggagagttgtgactagattagtggtttctaggatgcatgttggttgtttgttgggtaaaggtgggaagattattgagcagatgaggattgaaactaagactcatattcggattcttccaagagaaagtaacttacctcgttgtgtttcactctctgaagagattgttcaggtctgaaaaattgctattttgagaacatatttgaaatggtgaatcttgttgagattttgatatgaaatgtagtcagtttattgaaatgctagataatttaaatgtgtgattgtgaggttgaggttgttgacaagagttgaatcactcttatgtagttagcttggtcattatttgttatgtttaagctttctttggtgttttctacctatgggaaatgcatttataatgttggttctttcagattgtaggtgaactaaatgcagtgaaaaacgctttagccattgtatcatctcgtctaagggagagtcagcatcgtgatcggagtaatttccaagggcgttcacattcaccagaacggtcgtttgcagctgcgggggatgattacatgccacagctaagaagacaatcatccgataggtttcctcgtggtaattttagaaataacaacttcagttctcgccagtccaactatgcagaagaagctccagcagttccagttggtgagaatgtctactccgaagagcttgtgttccagattctctgcccagctgacaagattgttcgggttgttggggaatcgcaaggaataattgatttgcttcagaacgagatcggcgtggacgttagagtatctgacccagttgctggatctgatgaacagataatcaccatttcttcggaagaggtactctaaataccctcagatcttcttcaatattatctgttacatttacaattgtgaacttgaagttttgtattcttactttgcttaggcacctgatgatccatttttccctgctcaagaagccttgttgcacattcaaactcagatcatagatcttattccggataaagataatttaataacaacaagattacttgtcccatctagagactctatatgtttggaagggaaagcaggatcagtatctgagatatcacgattaactggaacaagcgtacaaattctagctagggaagaaattccccgatgtgcttctatcaatgatgttgttatacaggtatgtttgtctatttttgaggagtcgagcattttctaaacaacttctggtctcaaaagagaattcttatgtgaatgtcgatgtagattactggcgagatcagagctgctcgggaagcacttgttgaattaacattactattgaggagtcatatgttcaaggagctctctcaaaaggagacaccaccagcttccacatccacaactggccctctcgaaggtgttgcaggagtaatggaggtagcttcatcaaataacacaattcaatctcgtgaaggtcctactagttcgaatctgaacttgcagcaagttagcacaatcttgccacagtttaaggtttttgttctcatcaacaatcttttcaatataaaggcatctgtaatcagttagggtcagacttatttttgccatcgaaacaatgtaatattactatcaggctatgcataattacctgaatacttggaaagtagtctatggttcttgtccattcgtgcaatgtccctatatttacatatatttttctcttggtttttataggaaggtttcggatcagttgcaaaggcgggtgaaagtgaacaccgggaagaggttcctgtcacgacaagcaggtagagaaactcccaaatttgatatattttcccaaaaccgtacaagtgcttgtttcacacctttccttcctgctttttgtttttttctctagaatggcggtaccacttgttactagaagcactcttgaagttgtcttaccagaggcggttgttcctaagctcgttacgaaatcaagaaacaagcttgcacaaatcagtgaggtagaactctttttaactggaactagattggtgcaaatcatgactctaatcaaaatctttgacgctttgtcttatctctttcccacttgatcacagtggtctggagctagtgtaaccatagttgaagacagaccagaagaaacacagaatatcattcgaatttcgggtacacccgagcaagcagagagagctcagagtttgcttcaaggcttcattttgagcagtaagtttctctctttccaaacttttatatccgtattgtactgatctataagtctgatttccgttccttgtttggtgcagtacaagaggatggaccgtga

SEQ ID NO: 1604 - protein, 358 aa, Arabidopsis thaliana
  G1228 Amino Acid Sequence
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 1605 - DNA, 1672 bp, Arabidopsis thaliana
  G1228 Genomic Sequence
atggaaaggtttcaaggacacatcaacccctgtgtatgtatcttttgcttgatttagaaaacttttaactctctttcttcaatctttctctcttcccttgaatcatttttttccatactcagagacatggacttgcatttactcattcctaattagtccagatactgtgcatttaatgcttttgttgtttgttttagagaaaacagtaacaattcctaattagtccagatactgtgcatttaatgcttttgttgtttgttttagagaaaacagtaacaattctacaatcatttttgcttccctttctttgaaaacattccattttcctttctatttttttgcttatctctgtactaagaaccaaactaacccacagtagaactaaattacacttctctttcaatcatttgcgtctcaccggctaatctcattcctctgtcatttttacagttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgagtaaataaccaaaagcatacatgaaagtttcaacctttaatcatcaaaaccttatcaaatgttgtcctgcagggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaaggtaaacactactttccattttttacttcaatcaacaaaaacccaacattgaaaattgaatctttaattaaaaaatcttgttttttttttcaattgtgtcggagcagatggaagatgagtgcgacttagagtcagccgacgagattacggcggctgttcatcggattttcgatattccgacaatttga

SEQ ID NO: 1606 - DNA, 1672 bp, Arabidopsis thaliana; identical to SEQ ID NO: 1605
  G1228 DNA sequence used for BLAST

SEQ ID NO: 1607 - DNA, 1349 bp, Arabidopsis thaliana
  G1232 cDNA Sequence
gcatctctttcgcaaaaggcattgattttgctatagcgaatagtgataggggtttttttttctaagcgcagctctctcttctcaatttccccaaatgaaataaattcctccgaaagtttatagatttcactctcccccgaactatacaaaattccctcaaaaggaaaaactaaaaagccgatcttggcttttttgtttctgagtgcatctcgatacttggaagcattctttggtgaggctgattcattctcatcttgtgaaagtctttggcttttgaagcaatactatggaaggaattcagcatcctatacctcgcactgtcgaagaggtttttagcgactttcgtggtcgtagagctggtctcatcaaggctctctctactgatgtacagaagttttaccatcagtgtgaccctgagaaggaaaacttgtgtctttatggacttccaaatgagacatgggaggttaatcttcccgttgaggaggtccctcctgagcttcctgaaccagcgttaggcatcaatttcgcaagggacggaatgcaagaaaaagactggatttctttggttgcagttcacagtgattcatggcttatctctgttgcattttactttggtgcacgtttcggatttggcaagaatgagaggaagaggctcttccagatgataaatgatctcccaaccattttcgaggttgtaactggcaatgcaaagcaatccaaggatcaatctgctaaccacaacagtagcagaagcaaatctagtggtggcaagcctcgtcattctgaatctcacactaaggcttcaaagatgtcccctccaccaagaaaagaagatgagagcggagatgaggatgaagatgacgagcaaggtgctgtttgtggtgcgtgtggcgacaactatggaggagatgagttctggatatgttgtgatgcttgcgagaaatggttccatgggaaatgcgtgaagatcacaccagcaaaggctgagcatatcaaacattacaaatgcccaagttgcactaccagcaagaaaatgaaagcctgaaagtgataataacattagagcctgtgaaagaggaaaacgttttcacagtttaagaagacagtacaagagtttagctgtgggaagaagaagaaacaaaaggcttctgattgcgtagttttaatgggattgagacagcttacagttagtaatgtctctttctcttttcttttctttttttttgctgttaatgttaaaatgttatgactaatttgtcttaagtttctgagaaaattctgtcttttaaccactctctagtctatgtcaagtggtttcttcttctcggtaaaaaaaaaaaaaaaaaaaa

SEQ ID NO: 1608 - protein, 252 aa, Arabidopsis thaliana
  G1232 Amino Acid Sequence
MEGIQHPIPRTVEEVFSDFRGRRAGLIKALSTDVQKFYHQCDPEKENLCLYGLPNETWEVNLPVEEVPPELPEPALGINFARDGMQEKDWISLVAVHSDSWLISVAFYFGARFGFGKNERKRLFQMINDLPTIFEVVTGNAKQSKDQSANHNSSRSKSSGGKPRHSESHTKASKMSPPPRKEDESGDEDEDDEQGAVCGACGDNYGGDEFWICCDACEKWFHGKCVKITPAKAEHIKHYKCPSCTTSKKMKA

SEQ ID NO: 1609 - DNA, 1984 bp, Arabidopsis thaliana
  G1232 DNA sequence used for BLAST
tcaggctttcattttcttgctggtagtgcaacttgggcatttgtaatgtttgatatgctcagcctttgctggtgtgatcttcacgcatttcccatggaaccatttctcgcaagcatcacaacatatccagaactcatctcctccatagttgtcgccacacgcaccacaaacagcaccttgctcgtcatcttcatcctcatctccgctctcatcttcttttcttggtggaggggacatctttgaagccttagtgtgagattcagaatgacgaggctgcattagaaaacaaaggagtaagtagagataagaacccaacacagatacatggactgagagggcgaaaaaaaagagaaaacagaagcttctaccttgccaccactagatttgcttctgctactgttgtggttagcagattgatccttggattgctttgcattgccagttacaacctcgaaaatggttgggagatcatttatcatctggaagagcctcttcctgaaaggaattaataagatcagaggcaagataactaaaccatttgagtctataatatcagagaaaacaaacaatgttacttggctattcaacaaacatgatctttgacctaaattcttaaatctcaataaattttggttcagcttagatggaattcaatacatttgtaggttcacttctctctactgaaggagaaaaaatgatgatcacttcttcagggttgtttcacagaaacaggataacatgagtttagtgtgccagagatcgtcactagtatctacaacaacaactacacggtgtttggatgctagaattatgcagctactatactagtcattgaagctttaccaaacaagcaaaattaacaaacacagaacactgagcagagaaagaaacttacctctcattcttgccaaatccgaaacgtgcaccaaagtaaaatgcaacagagataagccatgaatcactgtgaactgcaaccaaagaaatccagtctttttcttgcattccgtcccttgcgaaattgatgcctaacgctggttcaggaagctcaggagggacctcctcaacgggaagattaacctcccatgtctcatttggaagtccataaagacacaagttttccttctctgcattagcaaaaaacgtaattcactaagaagtcaagaagagaaaccacaaagagaactaacttcatcttaggtacaaatctcacaaacacttaaaaagtctataatctgttcaaacatcatgaaccaaaaaaactgttcaaacagacaacaactctgacaggaagataatcaaagatataacacctaacagaggagtcaactagaaaaaggatcataacaacaagtctactgcagattagatgtaatcaggaagaagctaactaaaacaatctaacagaatttagaaaaacaaaagctgggaacaaaaagaatccgtgaacaaactcatgaagcaaaaaaaacgcatgtccaattacaatctcttccctaattcagacccgaaaggaactcttgcactgaaaaatcttaactttagcaaaaaaaaaaaaaacacatcttcctataaacaagataagaaccaatgcgttaggaagctatatacaagactttaaatgggtaacgaaataactcaccagggtcacactgatggtaaaacttctgtacatctgcaaaacaaaacacacaacaaaagaacatgaataaacccaaaacaggaagaagaaagccaaaatcttttgggggtttttttctcaggaaattaagaaaacccaattgaagaaacgagcactaaacatataaaaaaaactcgcaaatctacagaaatcatctaagattcgatcaaaagaaacagagtaaatagagaaagagagatcgagctgaccagtagagagagccttgatgagaccagctctacgaccacgaaagtcgctaaaaacctcttcgacagtgcgaggtataggatgctgaattccttccat

SEQ ID NO: 1610 - DNA, 1057 bp, Arabidopsis thaliana
  G1233 cDNA Sequence
gcatcgggtctcaaaaaccattgatacagacatcgatccttgtcaactagtactgatctataaatcttataaaaatctgtagagatatggccgccgcagccgtttcctctaaccctcgcaccgttgaagagatcttcaaagattattccgctcgtcgtgccgctcttcttcgtgctctcactaaagatgttgatgatttttactctcaatgcgatccggaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggaagcggttattcagtctgatcaacgatctcccaactctcttcgatgtagtgactggtaggaaagccatgaaagacaacaagccaagctcggactcaggaagcaaatccagaaatggcactaagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtgatgctgatcaattgatgatgatgatgatgatgatctctcagagagactctggttctcatgttttaatcaatatgttaatcaactttttttcttttcttctctttttttctttaaccttcttaattttaaagcatacaaaactctctctttagatctcaagaaagggatttcaagaagttgagggagagagtagcaaactgtttgaataatattattattattcatattaaa

SEQ ID NO: 1611 - protein, 246 aa, Arabidopsis thaliana
  G1233 Amino Acid Sequence
MAAAAVSSNPRTVEEIFKDYSARRAALLRALTKDVDDFYSQCDPEKENLCLYGHPNESWEVNLPAEEVPPELPEPALGINFARDGMQRKDWLSLVAVHSDCWLLSVSFYFGARLNRNERKRLFSLINDLPTLFDVVTGRKAMKDNKPSSDSGSKSRNGTKRSIDGQTKSSTPKLMEESYEEEEEEDEHGDTLCGSCGGHYTNEEFWICCDVCERWYHGKCVKITPAKAESIKQYKCPPCCAKKGRQ

SEQ ID NO: 1612 - DNA, 2032 bp, Arabidopsis thaliana
  G1233 DNA sequence used for BLAST
atggccgccgcagccgtttcctctaaccctcgcaccgttgaagagatcttcaaagattattccgctcgtcgtgccgctcttcttcgtgctctcactaaaggtctaaatcctctctctctctctttctctaaatttcccagatttcttcgtaatgcctttggattcgtcctttaacttgttcgtttttgtgattttttccagatgttgatgatttttactctcaatgcgatccgggtatgaaagatttcgacttttagatacccttttatgtgttttattgagatttgatttcaatttttgggtgtttgtggttatagaaaaggagaatttgtgtttgtacggacaccctaatgagtcatgggaagtgaatctaccagcagaggaagtgcctccggagctacctgagcctgctcttggtatcaatttcgctagagatggtatgcagaggaaagattggctttctcttgttgctgttcacagtgattgttggttgctctctgtttctttctactttggagcccgtcttaatcgcaatgagaggtatttctctttttcccaacattttgattctgcattctcattgttttgtgttttcttaagccatgtctccaacttttacttgatttcaatggattctgtgttgttcttacatgaaaccccatagttgttttccatcctggctcttctcatgtgaagtaaaaattgaaactttgtgatgatgatggagttcgtttggaatgagattgtctttgaatttgcgtgaaatgagttttgttttgttttgtttttttcgctattcgtcattcatatctatggagtattgtttgttgcatgacttcatctgtctaaactttttctcagctcttttggatattgtaatggctaaacttgaaacttgattatcctccctaattttaaaagcctggtatttgctattctatgaaatctgaaaacggatattctgtggtcgcatgtgctgaatttcaccatttcattgttacatctgaacacccatcttagtaactatggaatccaaagaactttactgacaaaggttttgtgaaagttaaattttgacaaaaaaaattgctatttgattagtactaatgagatcattttactgtctgtctgtcatatattctagaaaacaatgttattttggttattatctgtttcattgttcttcaagagagaagtagttgttggcatttagataggtttcaattaaaggtgcaagaaactggactttgttttctcaaccagtagtttcactataccattaacaagtctctaaagtgatcctctaccattttagtcctctatcttatttacactagactagtaaaaagcatttcgtaagatgcatttccaaggatagagaatttaacccgacagagctgcaaacaaataatgctagataaaacatcacaattgtgtgttgtactgatatgaagattctggttcgtttttcctcactttcgcttgctaatctagttcttagcttatcttagctgcctttttcaatgtgttgtccactcatggagttatattattcttttgatttgcaggaagcggttattcagtctgatcaacgatctcccaactctcttcgatgtagtgactggtaggaaagccatgaaagacaacaagccaagctcggactcaggaagcaaatccagaaatggcactaaggtacacaaaataaggagcctcctttcttcttttttgttatctggtttccctctttgaaatcaaaaatcgtaattagcagagatcaatagacgggcagacaaagagctcaacaccgaaactaatggaagagagctatgaggaggaggaagaagaagacgagcatggagacactctctgtggaagctgtggaggtcattacacaaatgaggagttctggatttgctgtgatgtttgtgaacgttggtaccatggaaaatgcgtcaagataactccggctaaagcagagagcatcaagcagtataaatgcccgccttgctgtgcaaagaaaggaagacagtga

SEQ ID NO: 1613 - DNA, 866 bp, Arabidopsis thaliana
  G1240 cDNA Sequence
gaagggccgcgccaatcttctatccttcgacgacccttcctctatataaggaagttcatttcatttggagaggacacgctgacttctgactctagcagatctggtacccgtcgacccacgcgtccgggttcttttctttttgtttcattttcttatctcctcacactcttcgaacaaggaagaaccctaatctcaagatgaatagggagaagttgatgaagatggctaataccgtccgcactggcggaaagggtactgtcagaagaaagaagaaggctgtgcacaagaccaatacaactgatgacaagaggcttcaaagcactcttaagagaattggagttaactccattcccgctattgaagaagttaacatctttaaggatgatgttgttattcagttcatcaaccctaaggttcaagcttcaattgctgcaaacacatgggttgttagcggttctcctcagaccaaaaaattgcaagatatccttcctcagatcatcagccaacttggaccagacaacatggacaacctgaagaagctagcagaacagttccagaaacaggcttctggtgaaggtaatgccgcctcagcaaccatacaagaagaggatgatgacgatgtcccagagcttgttggagagacattcgaaactgctgctgaagagaaagcaccagctgctgctgcttcttcttagagagaaaagagcgagaccacatccaaaaaaaaaccgcactttgatttttacatatctttataatatgtttgttcgctcgatcctttttgtagtttccgaccagaatcttgttttccatctaatgacttaaggtttttatccaaaaaaaaaaagaaaaaaaaaaaaaaaaaa

SEQ ID NO: 1614 - protein, 165 aa, Arabidopsis thaliana
  G1240 Amino Acid Sequence
MNREKLMKMANTVRTGGKGTVRRKKKAVHKTNTTDDKRLQSTLKRIGVNSIPAIEEVNIFKDDVVIQFINPKVQASIAANTWVVSGSPQTKKLQDILPQIISQLGPDNMDNLKKLAEQFQKQASGEGNAASATIQEEDDDDVPELVGETFETAAEEKAPAAAASS

SEQ ID NO: 1615 - DNA, 854 bp, Arabidopsis thaliana
  G1240 DNA sequence used for BLAST
ctaagaagaagcagcagcagctggtgctttctcttcagcagcagtttcgaatgtctctccaacaagctctgggacatcgtcatcatcctcttcttgtatggttgctgaggcggcattaccttcaccagaagcctgtttctggaactgttctgctagcttcttcaggttgtccatgttgtctggtcctgaaagagatcaaagtaacataaagttagagaccttaggatcgatgaagaacatttaagagctgtacagttacatggtacacaccaagttggctgatgatctgaggaaggatatcttgcaattctgcaggaagcaacacgtttacattaatcagagaagatgaaatgaagaagaaacaagaaagtagagattaagagatattatgagatgcaatacttttggtctgaggagaaccgctaacaacccatgtgtttgcagcaattgaagcttgaactgtagtaacattcaaaggaggaacaatgatcagtaacatgaaaaaaaggttctgatgtatagataaaaaatggttaaaaatgacttacccttagggttgatgaactgaataacaacatcatccttaaagatgttaacttcttcaatagcgggaatggagttaactccaattctcttaagagtgctttgaagcctcttgtcatcagttgtattggtcttgtgcacagccttcttctttctgcaagtaaaaatcgaatggtttcataacacaaatcatagtaaatgctaagtattgaacaatgaaattggttgaataaaactctataccttctgacagtaccctttccgccagtgcggacggtattagccatcttcatcaacttctccctattcat

SEQ ID NO: 1616 - DNA, 891 bp, Arabidopsis thaliana
  G1241 cDNA Sequence
gcgccgcttggatctctctctcctctgttctctcttcccttatcttcttcttatacccttcgaccaacgaagaaccctagaaatcgattaacaagatgaatagggaaaagttgatgaagatggctaacactgtccgcactggcggaaaggggacagtaagaagaaagaagaaggctgttcacaagaccactacaaccgatgacaagaggctccagagcactcttaagagagttggagtcaattccattcccgccattgaagaagttaacatttttaaggatgatgtagtcattcagttcattaaccctaaagttcaagcttcaattgctgctaacacatgggttgtgagtggtacaccacagacgaaaaaattgcaagacattcttcctcagattatcagccaacttggaccagataacttggacaacctgaagaagctagcagagcaattccagaaacaagctccaggtgcaggtgatgtcccagcaacaatccaagaagaggacgatgatgatgatgtcccagatcttgtagtgggagagactttcgagacccctgctactgaagaggctcccaaagctgctgcttcttagaggaggaggaagaagaaggagaagagctcacctgcaaaacccatcataaaaatgtttgtcgctcgacctcttctgagcactgtcagattcttgttttctctaatgcttgcgaacagaaagacttggttttattatcacttgatgctttttggtccgaacagcaattttccttttattaaggttagatcgctttttgtttaccacctgttcaaatgagtactactatgtcctgtcgcttcatacacttcttgcaacacagtcctttgttttgagtcaacgatgtcttgagatgaacaaa

SEQ ID NO: 1617 - protein, 165 aa, Arabidopsis thaliana
  G1241 Amino Acid Sequence
MNREKLMKMANTVRTGGKGTVRRKKKAVHKTTTTDDKRLQSTLKRVGVNSIPAIEEVNIFKDDVVIQFINPKVQASIAANTWVVSGTPQTKKLQDILPQIISQLGPDNLDNLKKLAEQFQKQAPGAGDVPATIQEEDDDDDVPDLVVGETFETPATEEAPKAAAS

SEQ ID NO: 1618 - DNA, 859 bp, Arabidopsis thaliana
  G1241 DNA sequence used for BLAST
atgaatagggaaaagttgatgaagatggctaacactgtccgcactggcggaaaggggacagtaagaaggtatactcatttatgtcttttctgtgaatttgtgtttttgccatttttcatgttatattctctaaacattttgactctcatttcagaaagaagaaggctgttcacaagaccactacaaccgatgacaagaggctccagagcactcttaagagagttggagtcaattccattcccgccattgaagaagttaacatttttaaggatgatgtagtcattcagttcattaaccctaaaggtaaaacatcaaattttatggctttataaatctcaggtttcgtataaaatttattgtattaatggttgttgtgtctctgttttaatgttgctatcacagttcaagcttcaattgctgctaacacatgggttgtgagtggtacaccacagacgaaaagtaagtgtttgtatcctcattgttgatccaatactattctcggtttatgcatagtctaatctcggaatgtgaattatcctgcagaattgcaagacattcttcctcagattatcagccaacttggtatgcagcattaagtgttacactctgatgtcctttcccaaaccagtggtcccttaagttaacattttgttttcttgctttgataatcgcaggaccagataacttggacaacctgaagaagctagcagagcaattccagaaacaagctccaggtgcaggtgatgtcccagcaacaatccaagaagaggacgatgatgatgatgtcccagatcttgtagtgggagagactttcgagacccctgctactgaagaggctcccaaagctgctgcttcttag

SEQ ID NO: 1619 - DNA, 738 bp, Arabidopsis thaliana
  G1249 cDNA Sequence
tcgaccgttcttctcaatctcaccaatcggtttaagctgaaaacccgaattagcaaaatcttcgttcgggctgttttggttaatccggtttacatgttttctcattgctcattttcattttcccgccgtgacagagcgcgtaaatctcaaaaccctaaaaatgtcgaacatatacaattcattaccttaatcagattttctcaacagaatcaaaatcaaaatccatggaggaagaagaaggatcaatccgaccagagtttccaatcggaagagtaaagaagataatgaaactggacaaagacatcaacaaaatcaactcagaagctcttcacgtcatcacttactccaccgaactcttcctccacttcctcgccgagaaatctgctgttgttacggcggagaagaagcgtaagactgttaatctcgatcatttaagaatcgccgtgaaaagacaccaacctactagtgatttcctcttagactcgcttccgttgccggctcagcctgtcaaacataccaaatcggtttccgacaagaagattccggcgccgccaattgggactcgtcgtatcgatgatttcttcagtaaagggaaagcaaagactgattcagcctaaagtaaaatttctcattttgttcacaattgcaaattttactctgttctcaaatcaaaatcttgttttgctaaaagtgtagtgagaatgtatggatcatgaggaacttttataggaagcggcc

SEQ ID NO: 1620 - protein, 130 aa, Arabidopsis thaliana
  G1249 Amino Acid Sequence
MEEEEGSIRPEFPIGRVKKIMKLDKDINKINSEALHVITYSTELFLHFLAEKSAVVTAEKKRKTVNLDHLRIAVKRHQPTSDFLLDSLPLPAQPVKHTKSVSDKKIPAPPIGTRRIDDFFSKGKAKTDSA

SEQ ID NO: 1621 - DNA, 472 bp, Arabidopsis thaliana
  G1249 Genomic Sequence
ctacacttttagcaaaacaagattttgatttgagaacagagtaaaatttgcaattgtgaacaaaatgagaaattttactttaggctgaatcagtctttgctttccctttactgaagaaatcatcgatacgacgagtcccaattggcggcgccggaatcttcttgtcggaaaccgatttggtatgtttgacaggctgagccggcaacggaagcgagtctaagaggaaatcactagtaggttggtgtcttttcacggcgattcttaaatgatcgagattaacagtcttacgcttcttctccgccgtaacaacagcagatttctcggcgaggaagtggaggaagagttcggtggagtaagtgatgacgtgaagagcttctgagttgattttgttgatgtctttgtccagtttcattatcttctttactcttccgattggaaactctggtcggattgatccttcttcttcctccat

SEQ ID NO: 1622 - DNA, 472 bp, Arabidopsis thaliana; identical to SEQ ID NO: 1621
  G1249 DNA sequence used for BLAST

SEQ ID NO: 1623 - DNA, 1140 bp, Arabidopsis thaliana
  G1258 cDNA Sequence
gctcatatccatcattctctctgatctcaagaaataatctcaaatctcttacactcatagtcttcaagcaacttctcagattcagctcttatggatcatttgttacaacaccaggatgtttttgggaattataacaaagcaagagaagcaatgggactatcatattcatcaaacccaacaccgttagataacgaccagaagaaaccttctcctgcaacggctgtgacaaggccacagcctccggagctagctctcaggtgtccacgttgcgactcaacaaacacaaagttttgttactacaacaactacagtctcactcagcctcgctacttctgcaaatcatgccggagatattggactaaaggtggaactctaaggaacatccccgtgggtggaggctgccggaaaaacaaacgatccacatcttcggctgcaagaagcctcagaaccactccagaaccggcgtcccacgacgggaaagtcttctcggcggcaggttttaatgggtatagtaacaatgaacatattgatctgagcttagcctttgccttgctgaacaaacaacatccggggagttcttcacagctagggtttcattcagaactcggtagctctcatcagtctgacatggaaggtatgtttgggacaagccaacaaaaagagaacgctacttatgcgtttggtaacgggagcagcggtttgggtgatccaagcagagtcttatggggatttccatggcagatgaatggagagagctttggaatgatgaacataggaggaggtggtggtcatgtagatcagattgattcagggagagagatgtggaccaatatgaactacattaattctggtgctttaatgtagttcaaaattaaaaccccaatattatttgggttttgatttagggtttgaatttcatgttttttaatgggagtagaaaagggtggtagctattttatgaaatggttaaggaagtatagatatattagggcttcttcaaagagtttcaaacttgcaaaatggggttggggtagttcttgttttcgatttctgatctaaattgttgagtttctttatttgtatgttcactatgtttaaatgaaacatttcctttgttgttctaaaaaaaaaaaaaaaaaa

SEQ ID NO: 1624 - protein, 257 aa, Arabidopsis thaliana
  G1258 Amino Acid Sequence
MDHLLQHQDVFGNYNKAREAMGLSYSSNPTPLDNDQKKPSPATAVTRPQPPELALRCPRCDSTNTKFCYYNNYSLTQPRYFCKSCRRYWTKGGTLRNIPVGGGCRKNKRSTSSAARSLRTTPEPASHDGKVFSAAGFNGYSNNEHIDLSLAFALLNKQHPGSSSQLGFHSELGSSHQSDMEGMFGTSQQKENATYAFGNGSSGLGDPSRVLWGFPWQMNGESFGMMNIGGGGGHVDQIDSGREMWTNMNYINSGALM

SEQ ID NO: 1625 - DNA, 874 bp, Arabidopsis thaliana
  G1258 Genomic Sequence
atggatcatttgttacaacaccaggtaaactacaattcaagatccacagtatctaacatcttgatgtgttttgttaatttgtctaattaagaatcttgatgtgtttattttttctcttttaaaggatgtttttgggaattataacaaagcaagagaagcaatgggactatcatattcatcaaacccaacaccgttagataacgaccagaagaaaccttctcctgcaacggctgtgacaaggccacagcctccggagctagctctcaggtgtccacgttgcgactcaacaaacacaaagttttgttactacaacaactacagtctcactcagcctcgctacttctgcaaatcatgccggagatattggactaaaggtggaactctaaggaacatccccgtgggtggaggctgccggaaaaacaaacgatccacatcttcggctgcaagaagcctcagaaccactccagaaccggcgtcccacgacgggaaagtcttctcggcggcaggttttaatgggtatagtaacaatgaacatattgatctgagcttagcctttgccttgctgaacaaacaacatccggggagttcttcacagctagggtttcattcagaactcggtagctctcatcagtctgacatggaaggtatgtttgggacaagccaacaaaaagagaacgctacttatgcgtttggtaacgggagcagcggtttgggtgatccaagcagagtcttatggggatttccatggcagatgaatggagagagctttggaatgatgaacataggaggaggtggtggtcatgtagatcagattgattcagggagagagatgtggaccaatatgaactacattaattctggtgctttaatgtag

SEQ ID NO: 1626 - DNA, 874 bp, Arabidopsis thaliana; identical to SEQ ID NO: 1625
  G1258 DNA sequence used for BLAST

SEQ ID NO: 1627 - DNA, 1340 bp, Arabidopsis thaliana
  G1261 cDNA Sequence
ggatgacgcacaatcccactatccttcgcaagacccttcctctatataaggaagttcatttcatttggagaggacacgctgacaagctgactctagcagatctggtaccgtcgacccacgcgtccgaaaagatcaacttcttcttcttaccaaaactgtcggcgtcgtctcctctaagctcctcccatggaagcagaagaaggtcatcagcgtgaccgcctctgcgactattgcgactcctccgtggctcttgtctactgcaaagctgactccgccaagctctgcctcgcctgcgacaagcaagtccacgtcgccaaccaactcttcgccaaacacttcaggtcacttctctgcgactcctgcaacgaatctccctcttcccttttctgcgagactgaaaggtctgttctttgccagaactgcgactggcaacaccacaccgcctcttcctcccttcatagccgcagaccctttgaaggatttaccggctgtccctccgtgcctgagttgctggccatcgttggcctcgatgacctcactctcgattccggattgctttgggagtcacctgagatcgttagcctcaacgaccttattgtttcgggcgggtcgggtactcataacttccgggccacggatgttcctcctctgcctaagaatcgtcacgccacctgcgggaaatacaaagatgagatgatccgacagctccgtggactatccagatctgagcctggttgtctgaaatttgaaaccccagatgctgagatcgatgccgggttccaattcctagcgccggatttgttttctacatgcgagctggagagtggactgaaatggttcgatcagcaagatcatgaggactttccatattgctctctgctaaagaacttgtcggagtcagatgagaaacctgagaatgtagaccgagagtcatcggtgatggttcccgtttccggctgcttaaaccgatgtgaggaagagactgtgatggttccggttatcactagtacaaggtcgatgacacatgagatcaacagtcttgagaggaactctgctctctctcgctacaaagaaaagaagaagtctcgaaggtacgagaaacacatcaggtatgaatcacgcaaggttcgtgcagaaagcaggacaagaatcaggggacgtttcgccaaggcagcagatccatgaatgatgatgaggttactttgataatcaaaaatcttttgtattaatcgaatcatatagtgtgtatgatcagataagtttttgtattctaagcttaggagttatcactgtatatcgaccacactctcaaaattgtcacttaagaatagtttttttaa

SEQ ID NO: 1628 - protein, 332 aa, Arabidopsis thaliana
  G1261 Amino Acid Sequence
MEAEEGHQRDRLCDYCDSSVALVYCKADSAKLCLACDKQVHVANQLFAKHFRSLLCDSCNESPSSLFCETERSVLCQNCDWQHHTASSSLHSRRPFEGFTGCPSVPELLAIVGLDDLTLDSGLLWESPEIVSLNDLIVSGGSGTHNFRATDVPPLPKNRHATCGKYKDEMIRQLRGLSRSEPGCLKFETPDAEIDAGFQFLAPDLFSTCELESGLKWFDQQDHEDFPYCSLLKNLSESDEKPENVDRESSVMVPVSGCLNRCEEETVMVPVITSTRSMTHEINSLERNSALSRYKEKKKSRRYEKHIRYESRKVRAESRTRIRGRFAKAADP

SEQ ID NO: 1629 - DNA, 1232 bp, Arabidopsis thaliana
  G1261 Genomic Sequence
atggaagcagaagaaggtcatcagcgtgaccgcctctgcgactattgcgactcctccgtggctcttgtctactgcaaagctgactccgccaagctctgcctcgcctgcgacaagcaagtccacgtcgccaaccaactcttcgccaaacacttcaggtcacttctctgcgactcctgcaacgaatctccctcttcccttttctgcgagactgaaaggtctgttctttgccagaactgcgactggcaacaccacaccgcctcttcctcccttcatagccgcagaccctttgaaggatttaccggctgtccctccgtgcctgagttgctggccatcgttggcctcgatgacctcactctcgattccggattgctttgggagtcacctgagatcgttagcctcaacgaccttattgtttcgggcgggtcgggtactcataacttccgggccacggatgttcctcctctgcctaaggtataacttgctctgttttttttctcgagccaattgctcggtttttatatttctctgaaatgttttgaaatgctccagaatcgtcacgccacctgcgggaaatacaaagatgagatgatccgacagctccgtggactatccagatctgagcctggttgtctgaaatttgaaaccccagatgctgagatcgatgccgggttccaattcctagcgccggatttgttttctacatgcgagctggtaatagagactgctattggttgtgttttcttgtgcttgtcaaatgattttccagcttataaatctctcttgtcaatatgaaggagagtggactgaaatggttcgatcagcaagatcatgaggactttccatattgctctctgctaaagaacttgtcggagtcagatgagaaacctgagaatgtagaccgagagtcatcggtgatggttcccgtttccggctgcttaaaccgatgtgaggaagagactgtgatggttccggttatcactagtacaaggtcgatgacacatgagatcaacagtcttgagaggaactctgctctctctcgctacaaagaaaagaagaagtctcgaaggtaaacaagctaatttaaaaagtgagacaccaccaataggattgggatttgaatcatgtgttgatgaaacaggtacgagaaacacatcaggtatgaatcacgcaaggttcgtgcagaaagcaggacaagaatcaggggacgtttcgccaaggcagcagatccatga

SEQ ID NO: 1630 - DNA, 1232 bp, Arabidopsis thaliana; identical to SEQ ID NO: 1629
  G1261 DNA sequence used for BLAST

SEQ ID NO: 1631 - DNA, 859 bp, Arabidopsis thaliana; identical to SEQ ID NO: 82
  G1266 cDNA Sequence

SEQ ID NO: 1632 - protein, 218 aa, Arabidopsis thaliana
  G1266 Amino Acid Sequence
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 1633 - DNA, 657 bp, Arabidopsis thaliana
  G1266 Genomic Sequence
atggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtga

SEQ ID NO: 1634 - DNA, 657 bp, Arabidopsis thaliana; identical to SEQ ID NO: 1633
  G1266 DNA sequence used for BLAST

SEQ ID NO: 1635 - DNA, 1166 bp, Arabidopsis thaliana; identical to SEQ ID NO: 50
  G1269 cDNA Sequence

SEQ ID NO: 1636 - protein, 287 aa, Arabidopsis thaliana
  G1269 Amino Acid Sequence
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 1637 - DNA, 1920 bp, Arabidopsis thaliana
  G1269 Genomic Sequence
atcaagaagatttgattgatcaaataaaaatgtttaagtacaaggatctcaatttctaactggttatatggaaagacacgaaactttggagtgatcttacgaatctaatccaaaaaaactttccctaatactctgacattatacacataatctgatgttgagatcaaaagagtttacacaactgacttgacacaaacgaacacttcaccacaaaggatatgataattttacattgtcaatgttttcttccacctttactctctttttgtaaggcatgaaccctctcatgttgttcatctcagtcaccgacgattttaactgagagaaagctgatctctcacttcttttgaactccgacactaccacttctgtttcagcgttttctgaagtagaagaagaacattgaagagactgtgtttctgagtatagcttcttcttgccatcttcagaatcatcacaactcattgaagagttgtaatcaccaactacaaaagtttttccaaagagcttaaggctctgtttggtctctgcttctagagacaatgattcctctgtgtgagatgataactcagctgaagaagagttaggtgaatttgaaccaatggaacctaatccatctgagccatgagctgataaaaccgatgttggagatcggttatcttcatcctgaatcagcttggatccggttagttcagcgtataccatctcttttgcatcaggaatcacaagctttctagggtaaggatgcatcggctttctctttggccttggaggcgggatctcaatggactcagagctaacaccaaaatcgcgagcaacctaataagaaaaacttgaattagaccttgcttaacacgaagaggttgaaactttttcatgtataagggtctgcaagaaggcaaaccttagtaaagaacttctgcgcatggcttcgaatctgaactgcagtttttgttccaacatgttctgttccatagaagaaccaacaaaagtcagatctctactcattactagggtccaagtagttttcttatatcttcatcaaacttagattagaatgtgcattagactctctaaagtcagataagcacacacaccttcgattcgtctccaagctctgccatagagtttcaatgcttctacaaacttctcatgctctgcttctgtccatttctctctttgtttagtgatggtataaggctttcttgtctataaacaaaacaaaccctaaattaacctcatatttaagttcaaaaccaatcaagagtaaacaagagattaagaaacaaaattagtaccttgaggtaaaaggcatctgaggaagatataagttcatcagaacataaactctcacaacgttcctataatcacaaagtaagaaaacacaattagtctcttaatatattgtaagagtaattaaatgttacaaagagtctaataaaactaattaatacgcaactagaagaggtagaccaccagtaataattaggggattagagacatgttcttacctaatacggatcaatacattaagaaagaagtaatctctctttaaaacaaccgaccataatatcccacataatcgcctggtctattaacacaatttttaacctgccacaatcgaataatcttcagttccaagttctctcagacaaagagattaaacttgaaattagataacaaaataacctattttctctcggacataaacctaagtttaggttaaatctgtctggattccacaagacttgaaacataacaacagtaacaaaaccaagatcaagattgcataaagaataacaaagaagatagatctcaaacctgcatagccatggttgcagaagaagaagaagaagacttgaagatttaagatctgaaatctgaagctgaagaagaagaataaagagagagagaattgtt

SEQ ID NO: 1638 - DNA, 1921 bp, Arabidopsis thaliana
  G1269 DNA sequence used for BLAST
atcaagaagatttgattgatcaaataaaaatgtttaagtacaaggatctcaatttctaactggttatatggaaagacacgaaactttggagtgatcttacgaatctaatccaaaaaaactttccctaatactctgacattatacacataatctgatgttgagatcaaaagagtttacacaactgacttgacacaaacgaacacttcaccacaaaggatatgataattttacattgtcaatgttttcttccacctttactctctttttgtaaggcatgaaccctctcatgttgttcatctcagtcaccgacgattttaactgagagaaagctgatctctcacttcttttgaactccgacactaccacttctgtttcagcgttttctgaagtagaagaagaacattgaagagactgtgtttctgagtatagcttcttcttgccatcttcagaatcatcacaactcattgaagagttgtaatcaccaactacaaaagtttttccaaagagcttaaggctctgtttggtctctgcttctagagacaatgattcctctgtgtgagatgataactcagctgaagaagagttaggtgaatttgaaccaatggaacctaatccatctgagccatgagctgataaaaccgatgttggagatcggttatcttcatcctgaatcagcttggatccggttagttcagcgtataccatctcttttgcatcaggaatcacaagctttctagggtaaggatgcatcggctttctctttggccttggaggcgggatctcaatggactcagagctaacaccaaaatcgcgagcaacctaataagaaaaacttgaattagaccttgcttaacacgaagaggttgaaactttttcatgtataagggtctgcaagaaggcaaaccttagtaaagaacttctgcgcatggcttcgaatctgaactgcagtttttgttccaacatgttctgttccatagaagaaccaacaaaagtcagatctctactcattactagggtccaagtagttttcttatatcttcatcaaacttagattagaatgtgcattagactctctaaagtcagataagcacacacaccttcgattcgtctccaagctctgccatagagtttcaatgcttctacaaacttctcatgctctgcttctgtccatttctctctttgtttagtgatggtataaggctttcttgtctataaacaaaacaaaccctaaattaacctcatatttaagttcaaaaccaatcaagagtaaacaagagattaagaaacaaaattagtaccttgaggtaaaaggcatctgaggaagatataagttcatcagaacataaactctcacaacgttcctataatcacaaagtaagaaaacacaattagtctcttaatatattgtaagagtaattaaatgttacaaagagtctaataaaactaattaatacgcaactagaagaggtagaccaccagtaataattaggggattagagacatgttcttacctaatacggatcaatacattaagaaagaagtaatctctctttaaaacaaccgaccataatatcccacataatcgcctggtctattaacacaatttttaacctgccacaatcgaataatcttcagttccaagttctctcagacaaagagattaaacttgaaattagataacaaaataacctattttctctcggacataaacctaagtttaggttaaatctgtctggattccacaagacttgaaacataacaacagtaacaaaaccaagatcaagattgcataaagaataacaaagaagatagatctcaaacctgcatagccatggttgcagaagaagaagaagaagacttgaagatttaagatctgaaatctgaagctgaagaagaagaataaagagagagagaattgttt

SEQ ID NO: 1639 - DNA, 748 bp, Arabidopsis thaliana
  G1275 cDNA Sequence
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 1640 - protein, 173 aa, Arabidopsis thaliana
  G1275 Amino Acid Sequence
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 1641 - DNA, 953 bp, Arabidopsis thaliana
  G1275 Genomic Sequence
atgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccggtaagtttctcttttggtttctaacaataagaacagatcatcgttaattcaaaaacataagcccctaactatgcgaacgtagacattaggacttgagcctaacagttttaggtgaaccaacatttgcagtttacaagtcattaactctgttttcttttttcctatttccatatgcaagacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaaggtagggaacaacatttcttattgcttaattacatctttcacatccaaccctttcatactattgtgactaaacaaaacacacagaaagatcattgagttcccttaattctattaaagaagcagaccaaatgtgagaaatcaaaagctaggaaattacgtgcctgttaaattcgagctgctctctgttatgacctgaaaatcaatacaccaaaagtaccattggttaatagcaatgatttctctgtaatttgcagaaactactacaaatgttcagttgatggctgtcccgtgaagaaaagggttgaacgagacagagatgatccgagctttgtgataacaacttacgagggttcccacaatcactcaagcatgaactaa

SEQ ID NO: 1642 - DNA, 953 bp, Arabidopsis thaliana
  G1275 DNA sequence used for BLAST
ttagttcatgcttgagtgattgtgggaaccctcgtaagttgttatcacaaagctcggatcatctctgtctcgttcaacccttttcttcacgggacagccatcaactgaacatttgtagtagtttctgcaaattacagagaaatcattgctattaaccaatggtacttttggtgtattgattttcaggtcataacagagagcagctcgaatttaacaggcacgtaatttcctagcttttgatttctcacatttggtctgcttctttaatagaattaagggaactcaatgatctttctgtgtgttttgtttagtcacaatagtatgaaagggttggatgtgaaagatgtaattaagcaataagaaatgttgttccctaccttggatgtgggctgttcttcaccatcttcttcccatactttctccacttgaacccgtcgtcaagcacttccacctcggaccgtgtcttgaacgcaactctccctttaatttttttcttttctttcttgttttggttgtcttgcatatggaaataggaaaaaagaaaacagagttaatgacttgtaaactgcaaatgttggttcacctaaaactgttaggctcaagtcctaatgtctacgttcgcatagttaggggcttatgtttttgaattaacgatgatctgttcttattgttagaaaccaaaagagaaacttaccggcagaagcagtggctgtagcagcaacataagttttggtacttggagattcaggatgactgaaacagctagaagaacctgagaataaagcaccagcaacatcactagtctgataaccataagactgattcatcccggaaaccgcagacacaagatcatcatccatccattcatctgacaagtctagctccggaaactcgaacacagagtgagtatcatcgctgaaactactccccaagtttgtgtctgcatcattcat

SEQ ID NO: 1643 - DNA, 2185 bp, Arabidopsis thaliana
  G1293 DNA sequence used for BLAST
ctagaagtgatgttgatgatggtgatgatacattgtagatgggtcttgatgatgatgatgatgccgactcataccttccctctgactgttatggtcatccccttgatctcgacctggacccatctgacccgtacctgctccaagattgagataaaccaatcttgaatccaaattgttattgctccctccactgcttccactattgtgctcctcattcatatgagggtaaatcccggtattgttatcattgttttggttgttgctattgtttccttcttctcgagatatcaccattgcagcggattgaacaagctcgaggcaaagcctaagtttattcggttcaatgtgagtcaatccaggaactgcccccttgaacaagaaatccgaagttaatgttctaaggatatcaagaggcgtgattccaccaactgtcctcacattaggatcagcatggtggtctaacagaacagccaccatgtctggagagaccatctcagccgcgatgtgcaaaggtgttttccctgccggacccgccggataattcacatcggcagctccaagctcaagcaaagccttcacaacttctctactacagctttcaacagcgtaatgcaatgctaacgactcatcaagattgagtccttctcccattaccatcagcttcactagttccacgtctgatgaatccaaagctcgtctcatccttctaatcttttgatcttctaggtcttgagccacgctgagatcatggtggtggttgtgaggcattagagaacggcgagctatagaagatttaagacgaagctcttctattttggtgacgacgtcaatagggagatgcttggcaagaatctctggtgggagacctgatttagcaactaagtgagagcaggtggtccataattgatgcatgtcttgctttcttgatgctattaaaactttcatcacatcttcgatagaggctttctccaccatgcttgccaattgtttctgccaatcatacaaaacaatttatttgataagtatgatataaatccaaagaaccgactttttcagcaagtggggtttaatttccatttttaggttatggatttttttgctattaattaactttcttgtcatctcagatggatttttgtatggtggagtaggttttattccttatctatagattagaatcgaaaccccaaatgaggaaaattgtgggattggataagaaattaagaccaagaaatgaatagatccaactacataacatagatttctacttttaggaaaattctcttccgtgcaataaaaccaccgttcgtctgctttcggaaactttatccgatgaaaattgttccaaagcaagaaacttaaactcatttatacatgaaatcaagacaagaacatatataatttaacaaataaaaaattgttattaaaaattaaaaatcttaagcgaaataccccatgaaagaaaataatcagaccaaaagggtttcgcgatttgtaataaatttaacccaaacccaaagaaagacaaataaaaatcgaatcaaaagcgtttcgtaatttaccaaaattaagccaagcacatgaaagaaaacactctaaaagaagcagaacaagaacaaaaaagtggaaactttcaattttgttttcttgtgatgtgcatggagtaagaagagtgaaagcagagggagaaagagagaacctgggtgagcaatgcgagctgctcgacgccgaagtaacgagaggcggcgagagtatcaagagcaagatcaacggcggctgagcaatgagtgtgccaacatcctctctcgccacaattaggtctaggctcgtgtttctgcggcacgatggagacttgtccgctataaagaaactgaagtagcaacagaaaaacctcataaccgactgagttcactggtataattccagctggggccgtggagcctcttgttgggctagcgggtacggacccatgttgggtcgggtctatacctgtgacaggttgtggtgagtctgtcccacaaaagaatttgcggaagaaaagactccgtgcggcgaggatacaacggtgagcgtggactaaacgaccttcaacgctgaaagtcacgtcggagaaagcttgaccgttgattagtaggttcaggaaatccaacgatagagatctcaaagattcttcaagattgctcat

SEQ ID NO: 1644 - DNA, 1000 bp, Arabidopsis thaliana
  G1300 cDNA Sequence
gtcttcttcaattattctattccctctgagagattctctctgcgtttcttagatcgagcgagcgaagcgagagatcatggaaggtggagctgctctctacaatcctcgaactgtcgaagaagttttcaaggatttcaaaggtcgtcgtactgccattgtcaaagctctcaccaccgatgttcaagagttttaccaacaatgtgaccctgagaaggagaatctttgcttgtatgggttaccgaatgaagaatgggaagtgaatttaccagctgaagaagtgcctcctgagttaccagagccagctcttggtattaactttgctagggatgggcactctgaaaaggaatggctttcgcttgttgctattcacagtgacgcttggatactgtctgtctcgttttactttggctcaaggttttctttccacaaggaagagaggaagcgtttgttcaacatgatcaatgatgttcctactatatttgaagtagtgactggaatggctaaagcaaaggacaagtcatctgctgcaaatcaaaacggaaacaaatccaagtctaactctaaagttagaacttcagagggaaaaagctcaaagaccaagcagccaaaagaggaggacgaagaaatagatgaagatgatgaggatgaccacggggaaaccctttgtggagcctgtggagacagtgatggtgctgatgaattctggatctgctgtgacctttgtgagaagtggttccatggcaagtgtgtgaagatcactccagctagagctgagcatatcaaacaatacaagtgcccttcatgcagcaacaaaagagctcgagcttaaaaatgttgtattgtagagaatagcctgtagtgacaactctcactaccctcgatctgtctttatttggctagtcttttagctcgttattggccataacagcttgggcctatttctctgtataattggtttgattttgcaactgagaaaaaaaaggaaactctttaactgaaa

SEQ ID NO: 1645 - protein, 250 aa, Arabidopsis thaliana
  G1300 Amino Acid Sequence
MEGGAALYNPRTVEEVFKDFKGRRTAIVKALTTDVQEFYQQCDPEKENLCLYGLPNEEWEVNLPAEEVPPELPEPALGINFARDGHSEKEWLSLVAIHSDAWILSVSFYFGSRFSFHKEERKRLFNMINDVPTIFEVVTGMAKAKDKSSAANQNGNKSKSNSKVRTSEGKSSKTKQPKEEDEEIDEDDEDDHGETLCGACGDSDGADEFWICCDLCEKWFHGKCVKITPARAEHIKQYKCPSCSNKRARA

SEQ ID NO: 1646 - DNA, 1491 bp, Arabidopsis thaliana
  G1300 DNA sequence used for BLAST
ttaagctcgagctcttttgttgctgcatgaagggcacttgtattgtttgatatgctcagctctagctggagtgatcttcacacacttgccatggaaccacttctcacaaaggtcacagcagatccagaattcatcagcaccatcactgtctccacaggctccacaaagggtttccccgtggtcatcctcatcatcttcatctatttcttcgtcctcctcttttggctgcttggtctttgagctttttccctctgaagttctctgcattcccaaaacaaagcaaaggaaatattaaactacacagatgaaaaaaactacagatatactcaaaaccaatccaaccaaagcagcgttttcggtgaagcattgtctctttgttttatccaccctactaagaaactacaatagtctggatgtggtattcaagattatgaattaatcgtgtttccgtcagctagtacatgattaagtgttgaaccatgaacatctttagtgatacaagtttccgaaaactgcaaaagcaaagagttaaaaaggatatagcaagagtcttacaactttagagttagacttggatttgtttccgttttgatttgcagcagatgacttgtcctttgctttagccattccagtcactacttcaaatatagtaggaacatcattgatcatgttgaacaaacgcttcctgaaaaaattacacaagttagcatgtacatatatacctgtgaagagtaggagaccaaaagagaaaccatccattacctctcttccttgtggaaagaaaaccttgagccaaagtaaaacgagacagacagtaaccaagcgtcactgtgaatagcaacaagcgaaagccattccttttcagagagcccatccctagcaaagttaataccaagagctggctctggtaactcaggaggcacttcttcagctggtaaattcacttcccattcttcattcggtaacccatacaagcaaagattctccttctctgaaaacccaaatcgtaacaatacaaaacacacaactttaatcaattaaccacacaaagagactaagtataaatcatattgtacaataccaataaccacaccatagactaagtataaatcatattgcagatttgtacaatacaataacacacaataagtctaaaacagatttgatctatacacagagaaaacccaagagaggatatgagtaaaagagaagaaaagaatcaaaattgggaagaaaagagagaaaccctaaccagggtcacattgttggtaaaactcttgaacatctgcaagaaaagcaaaaactcaaatcaattaggaaattgaacatagatcggagaagataacaatcactagaagcagaaagatctgagaagatagtgaaatttttaccggtggtgagagctttgacaatggcagtacgacgacctttgaaatccttgaaaacttcttcgacagttcgaggattgtagagagcagctccaccttccat

SEQ ID NO: 1647 - DNA, 912 bp, Arabidopsis thaliana
  G1309 cDNA Sequence
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 1648 - protein, 268 aa, Arabidopsis thaliana
  G1309 Amino Acid Sequence
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 1649 - DNA, 1020 bp, Arabidopsis thaliana
  G1309 Genomic Sequence
atgaccaaatctggagagagaccaaaacagagacagaggaaagggttatggtcacctgaagaagaccagaagctcaagagtttcatcctctctcgtggccatgcttgctggaccactgttcccatcctagctggtttttttttaatctctaaaatcttatattagactctctttttttcttaaccctatatcctatattagactcttaattctcatcattgttgttaatcttatccttaactaagagtaattgttgtgccaggattgcaaaggaatgggaaaagctgcagattaaggtggattaattacctaagaccaggactaaagagggggtcgtttagtgaagaagaagaagagaccatcttgactttacattcttccttgggtaacaagtaagaaaccctaataaaaaatacaccttctatttttgttgtctacaatccattcaggtctatgtgaaaaaccattcattaagtagatttttcatttgatttttatgatttgggtctgattaggtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttct

SEQ ID NO: 1650 - DNA, 1020 bp, Arabidopsis thaliana; identical to SEQ ID NO: 1649
  G1309 DNA sequence used for BLAST

SEQ ID NO: 1651 - DNA, 800 bp, Arabidopsis thaliana
  G1311 cDNA Sequence
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 1652 - protein, 238 aa, Arabidopsis thaliana
  G1311 Amino Acid Sequence
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 1653 - DNA, 969 bp, Arabidopsis thaliana
  G1311 Genomic Sequence
ttatgaccatagagaacatgaaaactcctcaaagtccctagtctcttgaaaccaccaagtaccaatgttaatattgttctcactgcagctattgctgctgtgatcttctgaaagatttgcttcactctggtcagtagaaatctctgatatccaatccgaaatccgattttcatacggtgatttcataacaccgaagctttctcttccaccaacaccaccgttggcttctttaccactttccatgctcacaacttcaacaaaaccatgttcttgagacgtcgtctttgtcctagtgatctctgtttccttatacttgtgcaacaattcttctcctgtatttcctctccactcaaagagctttcctgcagaaaaacacatcatttttttcaatgaatgcttatctaaaactaacatacatatgcaacaatgaaagaatatctaccatagttttgagcttcctgtttctttctataatgagttctccaatagttctttatctcgttatcagtcctaccgggtaatcttctcgcaatcttcgaccacctattgatatacaatatttgattaatcaaaccgcaaaaaacaatcatgtaagtacaagattcaagggttttttttgtctctcacttgttaccccatagagcatggagctgaaagatgattctctcttcttcttgactcatcggtccacgcttcagagtcggattcagatagttcatccaccttagcctgcaactcttaccactcctcttcaaacctatacgtatgaacacaacaaacatatatttcggacatgtaaatttctatttttggaaagtgacacaaaataaggtttcaaagtgtaccggaaactattgctaaagaatcccaacgacgttctcccaaaagactaatgaccttcactagccgttcgtcttcttcttcgagccatggccctctacgaagtgtttcttccttcttaaaatccat

SEQ ID NO: 1654 - DNA, 969 bp, Arabidopsis thaliana; identical to SEQ ID NO: 1653
  G1311 DNA sequence used for BLAST

SEQ ID NO: 1655 - DNA, 1011 bp, Arabidopsis thaliana
  G1315 cDNA Sequence
tttttcttttcccttcttctctttcaaaaaacaaaacaaagatatctcaaccggaacacttagaccaagagagacagatagagagatgggtagggctccatgttgtgacaaggcaaatgtgaagagaggtccatggtctcctgaagaagacgcaaagcttaaagattacatcgagaaacaaggaactggtggcaattggattgctctccctcacaaagctggtttaaggagatgtgcgaagagttgcagactgagatggttaaattatttgagaccaaacataagacatggagatttcactgaagaagaagacaatattatctacagcctctttgcctccattggaagcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactgatctcgagtaccaactttgatttaatctccaaa

SEQ ID NO: 1656 - protein, 297 aa, Arabidopsis thaliana
  G1315 Amino Acid Sequence
MGRAPCCDKANVKRGPWSPEEDAKLKDYIEKQGTGGNWIALPHKAGLRRCAKSCRLRWLNYLRPNIRHGDFTEEEDNIIYSLFASIGSRWSVIAAHLQGRTDNDIKNYWNTKLKKKLIATMAPPPHHHLAIATSSSSASPSSSSHYNMINSLLPYNPSTNQLLTPHQGIMMTMMGQQQQLFYQEDMGNLVNSPNRNNLIMSHQEDNQEQSTNKGIMLLSDVRSGSSTTSTVTRVKMEHRDHDDHHHHEEDERSMTSVVMEDYGMEEIKQLISSSCTSSNNSLWFDENKTEDKFMLYY

SEQ ID NO: 1657 - DNA, 1449 bp, Arabidopsis thaliana
  G1315 Genomic Sequence
atgggtagggctccatgttgtgacaaggcaaatgtgaagagaggtccatggtctcctgaagaagacgcaaagcttaaagattacatcgagaaacaaggaactggtggcaattggattgctctccctcacaaagctggtattttcatatctcatgattcgaatgggttaatttcttggacttttttttagtgttttctttgggttttggttgattttttttaataatctcttttataatctgatgtataaaggtttaaggagatgtgggaagagttgcagactgagatggttaaattatttgagaccaaacataagacatggagatttcactgaagaagaagacaatattatctacagcctctttgcctccattggaagcaggttaagaaagtcttagtatacatagtcatttttcaatattgatagatctgatctcttaaagatatgaaaagattactcttgtttaaatcatatgaaagaaatgaagaaagtgggtatcagaagaaaagaagagactatgtatgtatgtttcaaggatgattccatctcaattgttttattttccttaattaaaaactaatttctttcattgattttagcttttacatacccaccttttgtgcagtataattgcctccttttgtgggtatattctttaggtcataaattagccaaaaaaaaaacaaagtggaagcaaattcactttgaaaagtattgaagatttatggttacaaaattatttttttatttagcttattgtgataacataaaggagttaatcattgaaaatgcaggtggtcagtaatagcagctcacttgcaaggtagaactgataatgacatcaagaactattggaacactaagctcaagaagaagctcatagccaccatggctcctcctccacatcaccacttagccattgctacatcatcatcatcagcatccccatcatcatcatcacattacaacatgatcaatagtcttcttccgtataacccatcaacaaaccaacttctcacacctcatcagggtatcatgatgacaatgatgggccaacaacaacaactattttatcaagaagacatgggcaatttggtaaattctccaaacagaaacaatctcataatgagccatcaagaagacaaccaagagcaaagtacaaacaagggaataatgttgttgagtgatgtaagaagtgggtcgagtacaacaagtacagtaacaagagtgaagatggaacatcgtgatcatgatgatcatcatcatcatcatgaagaagatgagagatcaatgacctcggtagtgatggaagattatggaatggaggagatcaagcaattaataagtagtagttgtacgagtagtaacaatagcttgtggtttgacgaaaacaagacggaggataagttcatgttgtactactgatctcgagtaccaactttgatttaa

SEQ ID NO: 1658 - DNA, 1449 bp, Arabidopsis thaliana; identical to SEQ ID NO: 1657
  G1315 DNA sequence used for BLAST

SEQ ID NO: 1659 - DNA, 1142 bp, Arabidopsis thaliana
  G1319 cDNA Sequence
catcaatacattaccaagaaaccagagtttttcttcattgttcttttccacagcattgcaacatgaagagacattcttgttgttacaaacaaaagctgagaaaaggtctttggtctcctgaagaagatgagaaacttctcaattacattaccaaacatggccatggttgctggagttctgtccctaaactcgcaggtctcgagagatgtggaaagagctgtagactcagatggatcaattacttaagacctgatttaaagagaggagctttctcttcagaggaacagaatctcattgtcgagcttcatgctgttcttggaaacagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgtgaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctttagtttctttttcttatcagatttagacatattgatacgtgtaatgaatggatcaaatgttctatttggccatacgttaaaaaaataaaaaagcacaatcctttcctgaaaaaaaaaaaaaaaaaaaaaaaaaaaaaa

SEQ ID NO: 1660 - protein, 314 aa, Arabidopsis thaliana
  G1319 Amino Acid Sequence
MKRHSCCYKQKLRKGLWSPEEDEKLLNYITKHGHGCWSSVPKLAGLERCGKSCRLRWINYLRPDLKRGAFSSEEQNLIVELHAVLGNRWSQIAARLPGRTDNEIKNLWNSCIKKKLMKKGIDPITHKPLSEVGKETNRSDNNNSTSFSSETNQDLFVKKTSDFAEYSAFQKEESNSVSLRNSLSSMIPTQFNIDDGSVSNAGFDTQVCVKPSIILLPPPNNTSSTVSGQDHVNVSEPNCESNSGTTSHLNNPGMEEMKWSEEYLNESLFSTQVYVKSETDFNSNIAFPWSQSQACDVFPKDLQRMAFSFGGQTL

SEQ ID NO: 1661 - DNA, 3363 bp, Arabidopsis thaliana
  G1319 Genomic Sequence
atgaagagacattcttgttgttacaaacaaaagctgagaaaaggtctttggtctcctgaagaagatgagaaacttctcaattacattaccaaacatggccatggttgctggagttctgtccctaaactcgcaggtaaaactctctcttctccgaaaaaggcctaaaattgtgtttttgttccttaagtcatttacagaaccagagttgtatgattctataggtctcgagagatgtggaaagagctgtagactcagatggatcaattacttaagacctgatttaaagagaggagctttctcttcagaggaacagaatctcattgtcgagcttcatgctgttcttggaaacaggtaacaatcacaattacaattattctctgtttctgaaacagagtattttctgaaatcccctgttatcttgtatcagatggtcgcaaattgctgcgaggcttcccgggagaaccgacaacgagataaagaacttgtggaattcgtgcattaagaagaagctgatgaagaaaggcattgaccctattacacataaacccctctccgaggttggtaaagaaacaaacagaagcgacaataacaattccacaagtttttcctcagaaactaatcaagacttgtttgtcaagaaaacgtctgattttgccgagtattctgcgtttcagaaagaagaatccaactctgtttcactcagaaattcgctctcttccatgatcccaacgcaattcaacatcgacgatggttctgtctcaaatgcgggttttgatacacaagtatgcgtgaaaccctcgattattcttcttcctcctccaaacaacacttcaagcactgtctctggacaggatcatgtaaacgtgtcagagcctaattgggaatcaaacagtggaaccacaagccacctcaacaatcccggtatggaagaaatgaaatggtccgaggagtacctaaacgaatcgttattctctacccaagtttacgtgaaatcagagacggatttcaactccaacattgcctttccttggagccaaagccaagcttgtgacgtattccccaaggatcttcagagaatggccttctcttttggtggtcagaccctttagtttctttttcttatcagatttagacatattgatacgtgtaatgaatggatcaaatgttctatttggccatacgttaaaaaaataaaaaagcacaatcctttcctgaaaatgtgtcatatagaacattttgctcagattcatcaatatacgtctgtaaatttttagtttggtatcgaaataagtttcgtgcaatccttttgttgaaaagaatcatgatgctgtcgacaaatcaatagtcatttacaccaaacaaaaatcaaaagtcatatattttctgaatatatgaaaggagaaaaaagaatacaaatgcaggcattacttatttaagaaacctatttcctagaacacagtgtggtccaaagtcacatctttcaccattattcagacttcagaccctatattcagttaaaagacaaaaacaaaagatagagaaaacgactatttcaaatcactaaacaaaaaaaattcgaaaatctattaaattatataaacattaaaattactgtaagtaatacccccgatcctttaaatatctgtgatttaaagaagccactaaacaataagtgttactttaagtcaaaaacatatttctaatgaaatctctacgacttttaattaaactcaaacatagttctacgatcttgcatttgttattacatgcaaataaatatttatattctccttttttctatcttgaataacattctaattgttttaaatttaaaatatttttattagaggttccaattaattaattttcttacatttacattataagtactatatttagaaatcctattaaaaaccaatcacattattcctacttttctgacacttattcgttttcttataatttagtcatgaatcttttgcccttcaatattcatttatttcacaatctattgaaatttaattatagattgcaatatgcatataatttgattgataattaactaaattttctttttattaattgcaaatctttgcccaatctgtttccttaattacgtctataaatgcatcattacaaaaacccaccgaaaataacatcaaaagaagtaagcaaaagcaaaagtcctaatttctcctgtcatggacaccttacctcatcatctcctcgacgagattctcttcagaatagaccacagatctctggccatgatacaatgcacaaatagatctcttcaatctcatatacccaaaacccctaactttgcatccgaatacttttctcgggtcagatcaagtttgctatacatagcattcaatggctcccctttgctctgctaccacctttacggtgattctaggtcaccgcgaacagtagaagccttgacggagtgtcacattttaggctattgctctggccttcttctactcttcctcaataaaaatctctgcgtcgcaaatcctctcacaaagaagtttcgtttttttaatcactctaggtcaaagttttttcccttgggttactactctacgacgaggtcgtcaacaagtcatcgggttctctgtagatcagattgatcgaacaaccaatagttttaaaatcgtcatcataaacgaggtgagaaacagcaatgagacaacatatgagtttgagattaacgtaggctattcatggaaactatcggaaacgacgttaacttgctgcacaagtaatcttgatgaccgtatgaaaaaacctgtttatatgaagggaggtcttcactggctaagaaatgacggagctatcgtagctttcaaccctgaaacagagaaagcacgactgatctcgatcagattccccaaagaactttgttctaaaacgttgttcacagccgcagataacaatttaatcttgatatcggcgacggaagaagtcttttacgtttatgcagtagagaacattcttactgatcccaagtgggtcgtcttgaagcaaatccggaacggggtactggacgagaagatgctatatagttggtacccggaggcttacgatggaaagtgtttaatgctgagggagatattgaagaaggaccattacaagcaagtgcttcatgggtacgacctgagagctaataagtgggaagtcataggttcgattccagggtggtacacttcagctctagacttttatcagtttacaccgtctttgtcttcggtaataggacctgatgccaaggaggaggaagaaatattggcttgtgatcataaaaaaatctcctctataaactcaattattagaatgcttgatggaatctcatcctag

SEQ ID NO: 1662 - DNA, 3363 bp, Arabidopsis thaliana; identical to SEQ ID NO: 1661
  G1319 DNA sequence used for BLAST

SEQ ID NO: 1663 - DNA, 1041 bp, Arabidopsis thaliana
  G1321 cDNA Sequence
gttcttgtattggtttggatcggtatacttagttgattacgtaattaaatagatcggcgtgaagaagaaaaatgatcatgtgcagccgaggccattggagaccagctgaagacgagaagctcaaggatcttgtcgaacaatacggtcctcacaattggaacgccattgctctcaagcttcctggtcgctctggtaagagttgtagattgagatggtttaatcaattggatccaaggatcaaccgaaaccctttcacggaagaagaagaagaaagacttttagcggctcatcggatccatgggaacagatggtccatcatcgcaaggcttttccctggaagaactgataacgccgtcaagaaccattggcacgtcatcatggctcgtcgcacacgccaaacctctaagcctcgtcttcttccctcgacgacttcgtcttcttctttaatggcgagtgaacaaatcatgatgagttctggtggttataatcataattatagttccgatgatcggaagaaaatatttccagcagactttataaatttcccttacaaattctctcatatcaatcatcttcacttcctaaaggagtttttccccggaaagatcgctttaagtcacaaagcaaatcagagtaagaagcctatggagttctacaattttctacaagtaaacacagattcaaacaagagcgagattatagatcaagattcaggtcaaagcaaacgcagtgactcggacaccaaacatgaaagtcatgttccattcttcgactttttatccgttggaaactctgcctcctaggattagtttttttgcagtaactcctaaatttctagattaactatttagtccgtatacgtacgagattatctaggtcgttagcatgtatgcttgatgtgtataatcactaactagtgagctattacctgcgaaaattgtaagaaaaatacataatgttgatgtatcacacattctcaatgtctgtaaaatttccatcgagttgttaactatcaaagttatccgtttgaaaaaaaaaaaa

SEQ ID NO: 1664 - protein, 243 aa, Arabidopsis thaliana
  G1321 Amino Acid Sequence
MIMCSRGHWRPAEDEKLKDLVEQYGPHNWNAIALKLPGRSGKSCRLRWFNQLDPRINRNPFTEEEEERLLAAHRIHGNRWSIIARLFPGRTDNAVKNHWHVIMARRTRQTSKPRLLPSTTSSSSLMASEQIMMSSGGYNHNYSSDDRKKIFPADFINFPYKFSHINHLHFLKEFFPGKIALSHKANQSKKPMEFYNFLQVNTDSNKSEIIDQDSGQSKRSDSDTKHESHVPFFDFLSVGNSAS

SEQ ID NO: 1665 - DNA, 1235 bp, Arabidopsis thaliana
  G1321 Genomic Sequence
ctaaatagttaatctagaaatttaggagttactgcaaaaaaactaatcctaggaggcagagtttccaacggataaaaagtcgaagaatggaacatgactttcatgtttggtgtccgagtcactgcgtttgctttgacctgaatcttgatctataatctcgctcttgtttgaatctgtgtttacttgtagaaaattgtagaactccataggctttttactctgatttgctgcgatccaaacgataaaagaaggacgaaattataagctatgtggattgcaactatgttaaatatatagagatgacttcatgtaatgacggaaacaatatatgatgatgagtacaagaaaaaacatgcaactaattttgtcacataattttgaagttcattagaaaaatgattatgcaaatgaaaaagtcggctaaactctttgaaaagtaaaaaaattcggctaaacttcatttcaaaattttggaacatatatacctttttcatcaataatccgtgcaagactcatatacatgcaaacacatctatagaaaatggatccttctccatcattttgagtttacctttgtgatttaaagcgatctttccggtgaaaaactcctttaggaagtgaagatgattgatatgagagaatttgtaagggaaatttataaagtctgctggaaatattttcttccgatcatcggaactataattatgattataaccaccagaactcatcatgatttgttcactcgccattaaagaagaagacgaagtcgtcgagggaagaagacgaggcttagaggtttggcgtgtgcgacgagccatgatgacgtgccaatggttcttgacggcgttatcagttcttccagggaaaagccttgcgatgatggaccatctgttcccatggatccgatgagccgctaaaagtctttcttcttcttcttccgtgaaagggtttcggttgatccttggatccaattgattaaaccatctcaatctacaactcttacctgcatatatacaccaatacaattaattcatatgtatatatatatcaaagtatcaaaattaaccctagctagttttgtatatatggacaaaccctagaagatatcaattaccagagcgaccaggaagcttgagagcaatggcgttccaattgtgaggaccgtattgttcgacaagatccttgagcttctcgtcttcagctggtctccaatggcctcggctgcacatgatcat

SEQ ID NO: 1666 - DNA, 1235 bp, Arabidopsis thaliana; identical to SEQ ID NO: 1665
  G1321 DNA sequence used for BLAST

SEQ ID NO: 1667 - DNA, 1088 bp, Arabidopsis thaliana
  G1323 cDNA Sequence
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 1668 - protein, 273 aa, Arabidopsis thaliana
  G1323 Amino Acid Sequence
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 1669 - DNA, 986 bp, Arabidopsis thaliana
  G1323 Genomic Sequence
ttaatgtatgaggagctcgtaactctccaagagtgatgatgaatgttcatcttctgttccctgtttatgctgttgttgttgttgttggttatcgttttcttctaacccgagttcgctttccaggtgcttaaaccatttatcaacttcatcttcttcagactcttgaagagctctgttctctggttgttggaatgagtctgaaccatctatgaaactccaaatgtcaggatctaaatcaaaaggcatctccagcagctctggtttgtctacctcttgtaacatccccgtaaactcgctataagttagaatgtgctcaaacatttgacttatctgtgcatcatcgtctttgcttgaaatgttggaaccagcaaaagacattgaagcatttggagatgactcttgagagttctcttcttcattcaaagaaccttttgaacccgcttcatcggcattaaggttagtttccgagctcaatcttttcttgagatgtgtatgccacacattcttgatctcattgtctgttcttccaggcagcttagaagcaatcttcgaccacctgaatccaaaatgcagaaaagctattgtcaaaatcaaaactttgagcccacaacaagacattaacaagataacacatacttgttaccaaagctctggtgaagtttgatgatggtgtcttcttcctctgcactgaaattgccacgtttcacatcaggtctgaggtaattaatccatcgcagacgacaactcttgccacacctcaacaatccttcattgcatgcatagatagaatcagaaccagaagactagaaaagctaaagaaagaggcttttaaagatcatagacataccagcttgctttgggagagatctccaattctcatgaccattcttgtgaatgaaagagatgagtttcaagtcttcatcatggctccatggtcctctcttcactttggttttgtcacaacatggtgctcttcctttgcccat

SEQ ID NO: 1670 - DNA, 986 bp, Arabidopsis thaliana; identical to SEQ ID NO: 1669
  G1323 DNA sequence used for BLAST

SEQ ID NO: 1671 - DNA, 1137 bp, Arabidopsis thaliana; identical to SEQ ID NO: 83
  G1324 cDNA Sequence

SEQ ID NO: 1672 - protein, 286 aa, Arabidopsis thaliana
  G1324 Amino Acid Sequence
MENSMKKKKSFKESEDEELRRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTRVQKQARQLNIESNSDKFFDAVRSFWVPRLIEKMEQNSSTTTTYCCPQNNNNNSLLLPSQSHDSLSMQKDIDYSGFSNIDGSSSTSTCMSHLTTVPHFMDQSNTNIIDGSMCFHEGNVQEFGGYVPGMEDYMVNSDISMECHVADGYSAYEDVTQDPMWNVDDIWQFRE

SEQ ID NO: 1673 - DNA, 1043 bp, Arabidopsis thaliana
  G1324 Genomic Sequence
ttactccctaaactgccaaatgtcatccacattccacatgggatcttgtgtaacatcctcgtacgctgaataaccatccgccacgtgacattccattgagatgtccgagtttaccatgtaatcctccatgccaggaacatatcctccgaattcttgaacattgccttcatggaaacacatcgagccatcgatgatattggtgttgctttgatccataaagtgtggaactgttgttagatgagacatgcaagtagaagttgaagaagaaccgtctatgttgctgaaacccgagtaatctatatctttttgcatacttaaagagtcgtgagattgagaaggaagaagaagagagttgttgttgttgttttggggacaacaataagtagtagtagtggatgagttttgttccatcttctcgatcaatctagggacccaaaaactacgaacagcgtcaaagaacttgtcgctgttagattcgatgttgagttgacgagcttgtttttgaactcttgttctccaatagttcttgatctcgttatccgttcttcctggcaagtactgtgcaatcttggaccaccttagataacaaatattcgtttaggaaaaaagaaaaaaaaaacaaaaaaagaaaataaaagactcttgagatatgaaagtgactcatcactcacctattaccccatttagagtgaagctcaaggatcaaaagctgttcttgaggagtaagattccctcgtcttatgtcgggtttcaagtaattcaaccatctcaatctacaacttttcccagttctctttagccctgttctcatttttgttaaagatagtgattatatagtaaagtcagagaatctaactaataaaccaatatcaagttcttgattaattaccagcacatttggcgacgtgattccaacgaccctcaccgttatggaggatgtaatttgtgagaagtgtgtcttcctccaaagtccaaggccctcttcttagttcttcatcttcactttctttgaagctcttcttcttcttcatcgaattttccat

SEQ ID NO: 1674 - DNA, 1043 bp, Arabidopsis thaliana; identical to SEQ ID NO: 1673
  G1324 DNA sequence used for BLAST

SEQ ID NO: 1675 - DNA, 880 bp, Arabidopsis thaliana
  G1326 cDNA Sequence
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 1676 - protein, 250 aa, Arabidopsis thaliana
  G1326 Amino Acid Sequence
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 1677 - DNA, 858 bp, Arabidopsis thaliana
  G1326 Genomic Sequence
ctaagaagctaatccaacaccaagaaaatcaatgaaagtaacatcgttcttctcaccatcatctcccatggatggtccatcttcatttgaagtcatcttatgatctggtgtggctgcatgaaatgtgtaattctgaggatccaccaactctttcgactttctcctctcaagataaatttcgtggtgtacgttagagacagatgaagatccaaattgaccattcgtaggtggtgaaacaaaagagtaaggccagagaccgcaactcttatcctttcgatacctccatagcccgaaatgggatctatttagccttgtaagactagaactagggctcaaaacagtatgccaagtttggttgaacgtagaagtagccgtggaagagaagttttcccgtttgcgtctagccatgatgacatgaaaatggtttttgacagcgttgtcggtcctcccggggaacagtcgggctatggaggcccaacgattcccttggatccgatgagctttaagcagtctctcttcttcctcctcggtgaagggtttcttggtgatgtttggatcaagttggttgtaccatcttaatctacagcttttccctatgattccatattgacgctcaattatttataaaacacatagatttaagtaatatgattagatacatatatataaagaaatatcaatatatatatattgattacctgatcttccatagagatgttgagcaataaaattccagttcttgggaccgtattgttcaacgagttgccggagattgtcatcttcaacaggtctccagtgacctctttggcaactaggcttcttattgtcaaaactgttgcttcctctagacatctccat

SEQ ID NO: 1678 - DNA, 858 bp, Arabidopsis thaliana; identical to SEQ ID NO: 1677
  G1326 DNA sequence used for BLAST

SEQ ID NO: 1679 - DNA, 891 bp, Arabidopsis thaliana
  G1327 cDNA Sequence
atggggaaaggaagagcaccatgctgcgacaagaacaaagtgaagagagggccatggagccctcaagaagatctcactctcatcacttttattcaaaaacatggccatcaaaactggagatctcttcccaagcttgctggattgttgagatgtgggaaaagttgccgactaagatggataaactatctgagaccggacgtgaagcgaggcaactttagcaaaaaggaggaagatgctatcattcactaccatcaaacccttggaaacaagtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatga

SEQ ID NO: 1680 - protein, 296 aa, Arabidopsis thaliana
  G1327 Amino Acid Sequence
MGKGRAPCCDKNKVKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKKRLTPSSSSSSLSSTHDQSTKADHDKNCDGAQEEIHSGLNESQNSATSSHHQGECMHTKPELHEVNGLNEIQFLLDHDDFDDITSEFLQDNDILFPLDSLLHNHQTHISTQEMTREVTKSQSFDHPQPDIPCGFEDTNEESDLRRQLVESTTPNNEYDEWFNFIDNQTYFDDFNFVGEVCL

SEQ ID NO: 1681 - DNA, 1061 bp, Arabidopsis thaliana
  G1327 Genomic Sequence
tcatagacatacttctccgacgaaattaaaatcatcaaagtaagtttggttgtcaatgaagttgaaccactcgtcgtactcattgttaggtgtggttgattcaaccagctgtctcctcaagtcggattcttcgtttgtgtcttcaaatccgcatgggatatccggttgaggatgatcaaatgattgcgatttggttacctctcgagtcatttcttgggttgaaatgtgagtttggtggttatgaagaagagagtctagcggaaataagatatcgttatcctgaagaaactcagaggttatatcatcaaagtcatcatggtcgagcaggaactggatctcgttgagtccattaacctcatgaagctctggttttgtgtgcatacactcgccttggtgatgtgacgaagtagctgagttttggctctcatttaaccctgaatgtatttcttcttgagccccgtcacagttcttgtcatgatctgcttttgtgctttggtcatgagtgctagagagggatgaagaagaagaagatggagtgagtcgtttcttgagatgcgtgttccacacgtttttgatctcgttgtcagttcttcccggcaagaaggacgcgatctttgaccacctgatgatcacatatatcaattagtctctacatactatatattgtcttattataaagaaattagatgaataggtagagtacaaacttgtttccaagggtttgatggtagtgaatgatagcatcttcctcctttttgctaaagttgcctcgcttcacgtccggtctcagatagtttatccatcttagtcggcaacttttcccacatctcaacaatcctatgtatatatatcaatcattatttctcttagttatttaaaactttatagtattaccgaaacatgcatgtgaataaatactaaccagcaagcttgggaagagatctccagttttgatggccatgtttttgaataaaagtgatgagagtgagatcttcttgagggctccatggccctctcttcactttgttcttgtcgcagcatggtgctcttcctttccccat

SEQ ID NO: 1682 - DNA, 1061 bp, Arabidopsis thaliana; identical to SEQ ID NO: 1681
  G1327 DNA sequence used for BLAST

SEQ ID NO: 1683 - DNA, 1161 bp, Arabidopsis thaliana; identical to SEQ ID NO: 43
  G1328 cDNA Sequence

SEQ ID NO: 1684 - protein, 324 aa, Arabidopsis thaliana
  G1328 Amino Acid Sequence
MGRSPCCEKKNGLKKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLKMGIDPVTHTPRLDLLDISSILSSSIYNSSHHHHHHHQQHMNMSRLMMSDGNHQPLVNPEILKLATSLFSNQNHPNNTHENNTVNQTEVNQYQTGYNMPGNEELQSWFPIMDQFTNFQDLMPMKTTVQNSLSYDDDCSKSNFVLEPYYSDFASVLTTPSSSPTPLNSSSSTYINSSTCSTEDEKESYYSDNITNYSFDVNGFLQFQ

SEQ ID NO: 1685 - DNA, 1234 bp, Arabidopsis thaliana
  G1328 Genomic Sequence
ttattggaattggagaaaaccattaacatcaaacgaataattagtgatattatcactgtaataactctctttttcatcctcggtgctgcaagtgctactattgatgtaagttgaggaacttgagtttaacggagtcgggcttgaagaaggtgtggtcaagactgaagcaaagtcggagtaataaggttctaatacaaaattggacttcgaacaatcatcatcgtatgacaatgaattttggaccgtcgtcttcattggcatgaggtcttggaaattcgtgaattgatccatgatagggaaccaagattgtaattcttcattaccaggcatgttgtaaccggtttggtattggtttacttcggtttggttaaccgtgttgttctcgtgtgtgttgttggggtggttttggtttgaaaagagagaggttgcgagtttgagtatctcggggttaaccaatggttgatgattaccatcactcatcatgagcctcgacatgttcatatgttgttgatgatgatgatgatgatgatgcgaagagttgtagatagatgagctgagaatggaggagatatcgagaagatcaagacgtggagtgtgtgtaaccgggtcgattcccatctttagaagtctttttctgatgtgagtgttccaatagtttttgatctcgttgtctgttcttccaggcaaacgagccgcaatcgcagaccacctatacgaaagcaaacaaagttagaatctgatgcattgtagatttaacataaatcactagtaacatcattcaaagctatgactctaagactaatctacaagattagtagttttcgtataaactacgtaatggcaaaaatataaaattattgaaaagttcaaactcacttgtttcccatgatgctgtgaagttgaataatggtttcttcttcttcaaaagagaatcttccacgcttaatatctggtcggagatagttggtccaccggagacgacaactcttaccacatctttgtaaccctatagtcaagattcaagcaaaactttaaaaagacaattcacgaataaaaaaagtatgattaaaatgtaataatgaagatacgtatactaaccagcattcttgggaagagttctccaatttccataaccatgtatattgatataatcaatgagcttttgatcctcctcaggagtccatggtcctttcttgagaccattcttcttctcacaacatggtgatcgtcccat

SEQ ID NO: 1686 - DNA, 1234 bp, Arabidopsis thaliana; identical to SEQ ID NO: 1685
  G1328 DNA sequence used for BLAST

SEQ ID NO: 1687 - DNA, 925 bp, Arabidopsis thaliana
  G1329 cDNA Sequence
ccacgcgtccgtaccttttacaatttgtttatatattttacgtatctatctttgttccatggagggttcgtccaaagggctgcgaaaaggtgcttggactactgaagaagatagtctcttgagacagtgcattaataagtatggagaaggcaaatggcaccaagttcctgtaagagctgggctaaaccggtgcaggaaaagttgtagattaagatggttgaactatttgaagccaagtatcaagagaggaaaacttagctctgatgaagtcgatcttcttcttcgccttcataggcttctagggaataggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctaaggaaagccaagaggtagatattttggttcctgaagcgacgacaacagaaaagggggacaccttggcttttgacgttgatcaactttggagtcttttcgatggagagactgtgaaatttgattagtgtttcgaacatttgtttgcgtttgtgtataggtttgctttcaccttttaatttgtgtgttttgataaataagctaatagtttttagcattttaatgaaatatttcaagtttccgtgttac

SEQ ID NO: 1688 - protein, 212 aa, Arabidopsis thaliana
  G1329 Amino Acid Sequence
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHLSKKHEPCCKIKMKKRDITPIPTTPALKNNVYKPRPRSFTVNNDCNHLNAPPKVDVNPPCLGLNINNVCDNSIIYNKDKKKDQLVNNLIDGDNMWLEKFLRKAKR

SEQ ID NO: 1689 - DNA, 1269 bp, Arabidopsis thaliana
  G1329 Genomic Sequence
atggagggttcgtccaaagggctgcgaaaaggtgcttggactactgaagaagatagtctcttgagacagtgcattaataagtatggagaaggcaaatggcaccaagttcctgtaagagctggtatgttatttacgaacacacacacactaaccgacacacacacacacaaatatgaatatctataatcactaccaatagtcttcgttctctctattttctattcagaaaattgattaatacccggtattaaaaaaaaaaaaaaaaatttgtttaaatgagtacaaatcattgttacaacttctttatgctgtttttacatgctattaaaggttgtgcatgaaaatttcttttgctgttcgtatttgttttacacctaaacgaagatttttacttaaaattaaagaaaaaaaattatactaattttagttacgttgcgtattgctagcttctcctataaagtcgttcaaatttttacacgcttgtcttcttgtaaatgaattcgtgggaaaattttgtatgaacacgtgtttctgtgttggaacagttctttatttttattggtgtgcatagattcttcctgataaaatatatagaaggagacaaataaaaaacagtcttagtatgtaggtataatcaaagaatcaattattggttttgtagggctaaaccggtgcaggaaaagttgtagattaagatggttgaactatttgaagccaagtatcaagagaggaaaacttagctctgatgaagtcgatcttcttcttcgccttcataggcttctagggaataggtattaattgttacctcgatactacttaactcggagagtcgtcataagttaatactaataacatatgtatattttcttacaattgttaggtggtctttaattgctggaagattacctggtcggaccgcaaatgacgtcaagaattactggaacactcatctgagtaagaaacatgaaccgtgttgtaagataaagatgaaaaagagagacattacgcccattcctacaacaccggcactaaaaaacaatgtttataagcctcgacctcgatccttcacagttaacaacgactgcaaccatctcaatgccccaccaaaagttgacgttaatcctccatgccttggacttaacatcaataatgtttgtgacaatagtatcatatacaacaaagataagaagaaagaccaactagtgaataatttgattgatggagataatatgtggttagagaaattcctagaggaaagccaagaggtag

SEQ ID NO: 1690 - DNA, 1269 bp, Arabidopsis thaliana; identical to SEQ ID NO: 1689
  G1329 DNA sequence used for BLAST

SEQ ID NO: 1691 - DNA, 941 bp, Arabidopsis thaliana
  G1333 cDNA Sequence
cgtcgacgaaatgggaagagcaccggctgctacaagatggcggtgaagaaagggccatggtcgacggaggaagatgccgtgcttaagtcttacatcgaaaaacacggcaccggcaacaactggatttccctccctcagagaattgggataaagaggtgcgggaagagttgtcgtttgagatggcttaattacttgaggcctaacttaaagcatggaggcttcaccgatgaagaagattacatcatttgcagcctttacattactattggaagcaggtggtctatcattgcttcacaattaccgggaagaacagacaacgacatcaaaaactattggaacacgaggctgaagaagaagctattgagcaagcaagggaaggcatttcatcaacaacttaatgtcaaatttgagcgtggaacaacatcatcatcatcgagtcagaaccagatccaaatctttcatgatgagaacaccaaatcgaaccaaacattatataaccaagtggtggatccatcaatgagagcttttgccatggaagaacaaagcatgatcaagaatcagatattggaaccattttcttgggaaccaaacaaggttttgtttgatgttgattatgatgcagctgcttcatcttatcatcatcatgcatccccatcattgaactccatgagcagtactagtagtattggtactaataattcatctttacaaatgtctcactacaccgtcaatcacaatgatcatgatcaaccagatatgttctttatggacgggtttgagaatttccaggccgagctatttgatgagatagccaacaacaacacggtagaaaatggctttgacggaaccgagatcctgatcaataacaactacttggatcacgatattagctccttcattgattatcctctatacgataatgagttgatgatggattagcg

SEQ ID NO: 1692 - protein, 300 aa, Arabidopsis thaliana
  G1333 Amino Acid Sequence
MAVKKGPWSTEEDAVLKSYIEKHGTGNNWISLPQRIGIKRCGKSCRLRWLNYLRPNLKHGGFTDEEDYIICSLYITIGSRWSIIASQLPGRTDNDIKNYWNTRLKKKLLSKQGKAFHQQLNVKFERGTTSSSSSQNQIQIFHDENTKSNQTLYNQVVDPSMRAFAMEEQSMIKNQILEPFSWEPNKVLFDVDYDAAASSYHHHASPSLNSMSSTSSIGTNNSSLQMSHYTVNHNDHDQPDMFFMDGFENFQAELFDEIANNNTVENGFDGTEILINNNYLDHDISSFIDYPLYDNELMMD

SEQ ID NO: 1693 - DNA, 1107 bp, Arabidopsis thaliana
  G1333 Genomic Sequence
taatccatcatctactcattatcgtatagaggataatcaatgaaggagctaatatcgtgatccaagtagttgttattgatcaggatctcggttccgtcaaagccattttctaccgtgttgttgttggctatctcatcaaatagctcggcctggaaattctcaaacccgtccataaagaacatatctggttgatcatgatcattgtgattgacggtgtagtgagacatttgtaaagatgaattattagtaccaatactactagtactgctcatggagttcaatgatggggatgcatgatgatgataagatgaagcagctgcatcataatcaacatcaaacaaaaccttgtttggttcccaagaaaatggttccaatatctgattcttgatcatgctttgttcttccatggcaaaagctctcattgatggatccaccacttgattatataatgtttggttcgatttggtgttctcatcatgaaagatttggatctggttctgactcgatgatgatgatgttgttccacgctcaaatttgacattaagttgttgatgaaatgccttcccttgcttgctcaatagcttcttcttcagcctcgtgttccaatagtttttgatgtcgttgtctgttcttcccggtaattgtgaagcaatgatagaccaccttcattttaataaatatacaccaattattgatgcagcgtttaaataaaatcatatctatatcatataggataataggaatatataagagatctagctaggtaacaaacctgcttccaatagtaatgtaaaggctgcaaatgatgtaatcttcttcatcggtgaagcctccatgctttaagttaggcctcaagtaattaagccatctcaaacgacaactcttcccgcacctctttatcccttctcatcaaaatgtaaaattgttaagtattatatgtcacaactataaagtatataaaagaatttaaaatcaaacaaaggattttatagaaataccaattctctgagggagggaaatccagttgttgccggtgccgtgtttttcgatgtaagacttaagcacggcatcttcctccgtcgaccatggccctttcttcaccgccat

SEQ ID NO: 1694 - DNA, 1107 bp, Arabidopsis thaliana; identical to SEQ ID NO: 1693
  G1333 DNA sequence used for BLAST

SEQ ID NO: 1695 - DNA, 1274 bp, Arabidopsis thaliana; identical to SEQ ID NO: 104
  G1334 cDNA Sequence

SEQ ID NO: 1696 - protein, 269 aa, Arabidopsis thaliana
  G1334 Amino Acid Sequence
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 1697 - DNA, 1153 bp, Arabidopsis thaliana
  G1334 Genomic Sequence
atgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtaaactctctcaactttcatatgtaatgggagctttcggattgttcttactgaattctctaagtgggtatcaattagccttgaaagaagacattacctctctgtttcttgcacattacagagtgaatgcaaatgtttgaaggtgattttatttatgctgtcattgatttaggtggtgaaaagagttcaagagatgtgccaaagcctcatgttgctttcgcgatgcaatcagcttgcttcgagtttggatttgctcagccaatggtagagttctcttgcagtggaacatcacaaagaaaaactttcatttccctttaattgttttcttgagtatttgctgtgttttgttttcattgtagatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaaggtaacttattgaaactatctgatcattttttcagttatgcattcaaaaaatgttgccttatgttatgatgtttcagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatga

SEQ ID NO: 1698 - DNA, 1153 bp, Arabidopsis thaliana; identical to SEQ ID NO: 1697
  G1334 DNA sequence used for BLAST

SEQ ID NO: 1699 - DNA, 965 bp, Arabidopsis thaliana; identical to SEQ ID NO: 96
  G1335 cDNA Sequence

SEQ ID NO: 1700 - protein, 203 aa, Arabidopsis thaliana
  G1335 Amino Acid Sequence
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 1701 - DNA, 612 bp, Arabidopsis thaliana
  G1335 Genomic Sequence
atgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaa

SEQ ID NO: 1702 - DNA, 612 bp, Arabidopsis thaliana
  G1335 DNA sequence used for BLAST
ttaacgtccaccgctggtgcaatccctggcgaaatgtcccgactcgccacagctgtagcagcttcccccgccgccaccacctccacggccaccacctccgtaaccaccacctcctccgccgtatccgcctccacctccgtagccaccgccgcctcctccgtaacctccaccgccttcagaacagtctctcgccatgtgaccgggctcaccacacttgtagcagtcgctgcctcctcgaccaccacctcctcttcctccgtatccaccaccgccaccgccgtatccacctccagatccgcgtccacctcctcttcctccaccgaaaccgccgcgtccgccagatgaaccaccaccgctgtttccttggacgggagcgccgtcgggtccagaaacatcgatggccttgggacggttgttgttgtcgatctcaacctcgaactctacggcttcttcggcagcgaggctacggaaaccctcagatctgatggaggactggtgaacgaagagatcgtcgccaccgtcgtcaggagtgatgaagccgaaacccttctgggtatcaaaccacttgacggagcctttgcgcctctcaccaccgccgttgtctccgctcat

SEQ ID NO: 1703 - DNA, 1630 bp, Arabidopsis thaliana; identical to SEQ ID NO: 73
  G1337 cDNA Sequence

SEQ ID NO: 1704 - protein, 433 aa, Arabidopsis thaliana
  G1337 Amino Acid Sequence
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 1705 - DNA, 1890 bp, Arabidopsis thaliana
  G1337 DNA sequence used for BLAST
ttaagggtaaggagcttcactagctttcacaaatctgcctctgacacgcaacctagtgtcagctcttgccttcctcgattcataccttatggtcttatcatatctgttggcacccgagatccaagacaaagggagaaacgaaatatggtatcagattctttaagggagatgggcaataaaaaattattaaaggggaaagaaaaaagcagcatttacctccgtgtcttcctcttttccttgtaacgctgcattgcatctcctctgttctgagccagccgctccagatcagccttagttgcaactagtcttgtggtcttacaactagttccagcaatatgctctgtgaaatgcaagtcactggaggagttcgaacctttctcagagccaaaggtaattggacgattgttgctctcagattttgttggttgtacctggcctgaagttgatcgcttgtagtcatcctgcaaaagaatcctaatcagcatcacagttaagttgcatagcagtctagcaaatatatatcataagccaaaatgttagaattggtggcttggtgatgaggtaaaacaaagaaaagcaaaccagcttgtaacttttttctgactaggtttcatgttctgaattctatcattcactaaaagaagcaactgtctacaacaatttttgaggatgaacgggagatgacaacgtattgtgttttaaacactactctacttaaatgactaaggttaatgagaactattacctttttaatctctttgacacctttcacattagtggaacaagtttcattcatatggtcaacaaaattgttgattgtgaatgaagaagcagcacctttccctacatatgcagcttccactcgactcgtatcctcaggtccccgtgactgtcccaagttaaaatcccatatctgtatacaagttcacaacacaggttaagaaacctttcatttttttatcttcttgagaaaccataaaaccacacagagtgactatatttgaccttacacaaaaacatttcaccacttaatctcacttgctcattaacagaaaaaactaaactgttcttagccaaaaaaatcaaaagagagataagcaaaacctgagaactctggccaccactaggattagtagtagtagcattccactgctggttaactcctcctcctccgccaccattgatctcctcaacatctcttgaccatttcaatctctctgacatctccggaaccataagcccctctcctgcttctccatctccatctccatcacaagcaccctcacggtcacaatcacggtcacgatcaccatcatcgccatcaccaccgacaacaccactcttaagcaactcctcaagctgcttacacaatacctgcttatacctcccacaactagatccacaagatccacgcttcttaaacgtcgtatcgctgggaacaatcaattcattagatcccaaaacccaagaatccaactgcatcccgaaattatccatcatcatcgccatcatcggaacttgattctcttcatctttcctcccttgctccaaatcaagtccccataaagcagcaagctccaacgccgatggacaaccggaaaaaccttccacggcggatcgaacatgagcatcggaaactgaacaacttccgtgaacatcccaatcacactcctgacacaaaatcagattatcggtgaaacaccgaacagagactggctcgttaccgcaattatcgcagatctgagatcgcacgtgcttcctcgacaacagattcgccgtgtgaacttgctgatcacaaggcaaacacagcttcgccgtatcggctctacaaaacaaaaccgccgtacgctcgccgcagaaatcgcacggtactctctccgaactactcat

SEQ ID NO: 1706 - DNA, 1211 bp, Arabidopsis thaliana
  G1338 cDNA Sequence
ctcaattcccaaattcgcaatcgtaatggcgattctcctcaagctttcgtcttgctgatcctttaaaggttgttgtttggtttttgatcacaaagtctcatactttttggttaagattcaatcaaaagagtcaaaggttacttctttgttactgggttttgagtaatggacgacggtgagcttgagttttcgaattcaaacatgggtggtgaattacctagctgttcgatggattcgttcttcgatgagcttttgagagattctcatgcttgtactcatactcacacttgtaatcctccgggaccagagaacacacatactcacacatgtctccatgtgcacaccaagattcttcctgacaaagtttctactgatgatacatcggaatcttcagggaagaagagacctttagggaatagagaagcggttagaaagtatagggagaagaagaaggctaaagcggcttcgttggaggatgaggttatgaggcttaaggcggttaataatcagctgttgaagaggttgcaaggtcaagctgcattggaagctgaggttactaggctcaagtgtttgcttgttgatataagaggaagaattgatggagagattggtgcgtttccttatcagaaacctgcggttacaaacgtgccttactcatacatgatgcatccttgcaatatgcaatgtgatgttgataacttgtactgccttcaaaatgggaataatggagaaggtgcatcgatgaatgagcaagggctaaatggttgtgagtttgatcagctagaatgcttggctaatcagaatttagctggcaaggagatccctgtttgtagtaatggaattggaacattcactgtcaatggatccggcgttaataagagaaaaggtgagcctcgagcagcgaaagcagtttgaagtatcatcaatcatgtgatactatcaatcattcaccccattttcaagttggtagttaattttcttccaataagtagtagagttcaactgcatcaccagcttccttcaagtccatttgtgctatcatcaggtttttagtctctttgcatttccttgttgagctcgttgaagctagaaataagacttgttaatattcaaatcgagtttgctatttggttttgtactttagtagcttctttttttgttgtgaagttcttgtagaagagattgaatgttgcatttggaaaagtaagtta

SEQ ID NO: 1707 - protein, 249 aa, Arabidopsis thaliana
  G1338 Amino Acid Sequence
MDDGELEFSNSNMGGELPSCSMDSFFDELLRDSHACTHTHTCNPPGPENTHTHTCLHVHTKILPDKVSTDDTSESSGKKRPLGNREAVRKYREKKKAKAASLEDEVMRLKAVNNQLLKRLQGQAALEAEVTRLKCLLVDIRGRIDGEIGAFPYQKPAVTNVPYSYMMHPCNMQCDVDNLYCLQNGNNGEGASMNEQGLNGCEFDQLECLANQNLAGKEIPVCSNGIGTFTVNGSGVNKRKGEPRAAKAV

SEQ ID NO: 1708 - DNA, 959 bp, Arabidopsis thaliana
  G1338 Genomic Sequence
atggacgacggtgagcttgagttttcgaattcaaacatgggtggtgaattacctagctgttcgatggattcgttcttcgatgagcttttgagagattctcatgcttgtactcatactcacacttgtaatcctccgggaccagagaacacacatactcacacatgtctccatgtgcacaccaagattcttcctgacaaagtttctactgatgatacatcggaatcttcagggaagaagagacctttagggaatagagaagcggttagaaagtatagggagaagaagaaggctaaagcggcttcgttggaggatgaggttatgaggcttaaggcggttaataatcagctgttgaagaggttgcaaggtcaagctgcattggaagctgaggttactaggctcaagtgtttgcttgttgatataagaggaagaattgatggagagattggtgcgtttccttatcagaaacctgcggttacaaacgtgccttactcatacatgatgcatccttgcaatatgcaatgtgatgttgataacttgtactgccttcaaaatgggaataatggagaaggtgcatcgatgaatgagcaagggctaaatggttgtgagtttgatcagctagaatgcttggctaatcagaatttagctggcaaggagatccctgtttgtagtaatggaattggaacattcactgtcaatggatccggcgttaataagagaaaaggtgacattctagttcctttggatctctttcctagaggctgtccttaatagctatatctttatacagttttcatcgtagttacttccatattgtcactgtacttatcctggaattgtgtcatttctgaggttcccttgaacgttttttgtttaaacttgtggtttgtgtatattttgtttatgaactcaaggtttttgatcttgcaacaggtgagcctcgagcagcgaaagcagtttga

SEQ ID NO: 1709 - DNA, 959 bp, Arabidopsis thaliana; identical to SEQ ID NO: 1708
  G1338 DNA sequence used for BLAST

SEQ ID NO: 1710 - DNA, 1435 bp, Arabidopsis thaliana
  G1340 cDNA Sequence
caattatttaatttagtaggaaacatagaataaaaaaacttgctttgtttttcatattttctcattattggaatcactgtcttttcgaacttggtgacaatcttagtactagaaaacaaaagactttgaccggtctttggctcatctctttcttctcccctttctccaacacttatttctttctctctctagttcatgaattcaagattcaaagacacacgtatggctacctcttggtaaatccaaagagacacatatatggctgacgctgatccatcgagtggtgaacagatagttatgagagagtgcagaaaagggaattggacagtgagtgagactttggttctcatagaagccaagaagatggacgaccagaggcgtgtacggcgatcggaaaaacaacctgaaggcagaaacaaaccagcagagctccggtggaaatggatagaggagtattgctggagaagaggatgttaccgcaaccagaatcagtgcaacgataagtgggacaatctcatgagggattacaagaagatcagagagtacgagagatcaagggtagaatcgtcttttaacaccgtcacttcttcctcttactggaagatggacaagactgagaggaaagagaagaacttgccgagtaacatgttgcctcagatatacgacgtgttgtctgagcttgttgacagaaaaactcttccttcctcctcctccgccgccgccgccgtaggaaacggtaacggtggccagatcctaagagtttgccaacaaagtttaggatttgtagctccgatgatggctcagccgatgcatcaaatcccgactactatagtgttatctcttccgccaccaccgccacagtctcttagcttatcacttccttcgccgcctcaacctccaccatcgtcttcatttcacgctgagcctataccgcccacagtaggtacatcatcgacaaagcgaatgagaacaacgccgggagaaaccaccgctggaggagagagggaggtagaggaggatgcggttggggtggcgttgtctagatgcacgtctgtgatcacacaagtgataagagagaatgaggagggacaagagaggaggcataaggaagtggtgaggctacaagagaggagactaaagattgaggaatcaaaaactgaaataaatagacaaggtatgaatggtttggtagacgccattaatcaactcgcaagctctattcttgctttggcttcttcttcttgccataataatcgcatcatcaaggaggtccaccatgatacctatattgaatagatgtgttactttaatacttaagttgatgattagttgcttagttaatatgtaggtatgtgtatataaagtgacgttatgttagcatataaaaccatgcaagatgttcttgtcatggagtaattaatgaatcattaatcaa

SEQ ID NO: 1711 - protein, 345 aa, Arabidopsis thaliana
  G1340 Amino Acid Sequence
MADADPSSGEQIVMRECRKGNWTVSETLVLIEAKKMDDQRRVRRSEKQPEGRNKPAELRWKWIEEYCWRRGCYRNQNQCNDKWDNLMRDYKKIREYERSRVESSFNTVTSSSYWKMDKTERKEKNLPSNMLPQIYDVLSELVDRKTLPSSSSAAAAVGNGNGGQILRVCQQSLGFVAPMMAQPMHQIPTTIVLSLPPPPPQSLSLSLPSPPQPPPSSSFHAEPIPPTVGTSSTKRMRTTPGETTAGGEREVEEDAVGVALSRCTSVITQVIRENEEGQERRHKEVVRLQERRLKIEESKTEINRQGMNGLVDAINQLASSILALASSSCHNNRIIKEVHHDTYIE

SEQ ID NO: 1712 - DNA, 1364 bp, Arabidopsis thaliana
  G1340 Genomic Sequence
atggctgacgctgatccatcgagtggtgaacagatagttatgagagagtgcagaaaagggaattggacagtgagtgagactttggttctcatagaagccaagaagatggacgaccagaggcgtgtacggcgatcggaaaaacaacctgaaggcagaaacaaaccagcagagctccggtggaaatggatagaggagtattgctggagaagaggatgttaccgcaaccagaatcagtgcaacgataagtgggacaatctcatgagggattacaagaagatcagagagtacgagagatcaagggtagaatcgtcttttaacaccgtcacttcttcctcttactggaagatggacaagactgagaggaaagagaagaacttgccgagtaacatgttgcctcagatatacgacgtgttgtctgagcttgttgacagaaaaactcttccttcctcctcctccgccgccgccgccgtaggaaacggtaacggtggccagatcctaagagtttgccaacaaagtttaggatttgtagctccgatgatggctcagccgatgcatcaaatcccgactactatagtgttatctcttccgccaccaccgccacagtctcttagcttatcacttccttcgccgcctcaacctccaccatcgtcttcatttcacgctgagcctataccgcccacagtaggtaccttccgttttatctctcttcttattcttaaagcctaattaaatgaccactaaagttagattttatattaaatctataaagtggatttcgacattccaacaaacaccctcaagtcaacttgttattaattataatcaatctaattataaatttaaaatcaaaacttatacaattactatgaaggaaaaaatgtaaccctaaatttgcttgtgtgtgcatagacaattctttacaataaagttcttgagtacattaagattaaagtagtaattaaacccgcattttggtcgatgaagagactgataagagtgtgtacattcaggtacatcatcgacaaagcgaaggagaacaacgccgggagaaaccaccgctggaggagagagggaggtagaggaggatgcggttggggtggcgttgtctagatgcacgtctgtgatcacacaagtgataagagagaatgaggagggacaagagaggaggcataaggaagtggtgaggctacaagagaggagactaaagattgaggaatcaaaaactgaaataaatagacaaggtatgaatggtttggtagacgccattaatcaactcgcaagctctattcttgctttggcttcttcttcttgccataataatcgcaatcatcaaggaggtccaccatgatacctatattgaatag

SEQ ID NO: 1713 - DNA, 1364 bp, Arabidopsis thaliana
  G1340 DNA sequence used for BLAST
ctattcaatataggtatcatggtggacctccttgatgattgcgattattatggcaagaagaagaagccaaagcaagaatagagcttgcgagttgattaatggcgtctaccaaaccattcataccttgtctatttatttcagtttttgattcctcaatctttagtctcctctcttgtagcctcaccacttccttatgcctcctctcttgtccctcctcattctctcttatcacttgtgtgatcacagacgtgcatctagacaacgccaccccaaccgcatcctcctctacctccctctctcctccagcggtggtttctcccggcgttgttctccttcgctttgtcgatgatgtacctgaatgtacacactcttatcagtctcttcatcgaccaaaatgcgggtttaattactactttaatcttaatgtactcaagaactttattgtaaagaattgtctatgcacacacaagcaaatttagggttacattttttccttcatagtaattgtataagttttgattttaaatttataattagattgattataattaataacaagttgacttgagggtgtttgttggaatgtcgaaatccactttatagatttaatataaaatctaactttagtggtcatttaattaggctttaagaataagaagagagataaaacggaaggtacctactgtgggcggtataggctcagcgtgaaatgaagacgatggtggaggttgaggcggcgaaggaagtgataagctaagagactgtggcggtggtggcggaagagataacactatagtagtcgggatttgatgcatcggctgagccatcatcggagctacaaatcctaaactttgttggcaaactcttaggatctggccaccgttaccgtttcctacggcggcggcggcggaggaggaggaaggaagagtttttctgtcaacaagctcagacaacacgtcgtatatctgaggcaacatgttactcggcaagttcttctctttcctctcagtcttgtccatcttccagtaagaggaagaagtgacggtgttaaaagacgattctacccttgatctctcgtactctctgatcttcttgtaatccctcatgagattgtcccacttatcgttgcactgattctggttgcggtaacatcctcttctccagcaatactcctctatccatttccaccggagctctgctggtttgtttctgccttcaggttgtttttccgatcgccgtacacgcctctggtcgtccatcttcttggcttctatgagaaccaaagtctcactcactgtccaattcccttttctgcactctctcataactatctgttcaccactcgatggatcagcgtcagccat

SEQ ID NO: 1714 - DNA, 1230 bp, Arabidopsis thaliana
  G1349 cDNA Sequence
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggaatggttcttatgaatgggaagaccatagatcagtcagagcttacaaaggaacagatggtggagcagctttctgtttcagtgcttgtgacgatgatgaatccagtggttacactcctgtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggagccactgctaacatcatctgaggaatttgacgtgtacgcgacaaagtttgtactctgaatgctgtacatatgatgctgcaaatagctcggaaacgtttctatgtgtatgtatcatgtaatgattatgttgcatagcctctctcttcttacgagcaataagctatgaaataattgattcgctaagaaatttaaaatgaaa

SEQ ID NO: 1715 - protein, 362 aa, Arabidopsis thaliana
  G1349 Amino Acid Sequence
MASRREVRCRCGRRMWVQPDARTVQCSTCHTVTQLYSLVDIARGANRIIHGFQQLLRQHQPQHHEQQQQQMMAQPPPRLLEPLPSPFGKKRAVLCGVNYKGKSYSLKGCISDAKSMRSLLVQQMGFPIDSILMLTEDEASPQRIPTKRNIRKAMRWLVEGNRARDSLVFHFSGHGSQQNDYNGDEIDGQDEALCPLDHETEGKIIDDEINRILVRPLVHGAKLHAVIDACNSGTVLDLPFICRMERNGSYEWEDHRSVRAYKGTDGGAAFCFSACDDDESSGYTPVFTGKNTGAMTYSFIKAVKTAGPAPTYGHLLNLMCSAIREAQSRLAFNGDYTSSDASAEPLLTSSEEFDVYATKFVL

SEQ ID NO: 1716 - DNA, 1367 bp, Arabidopsis thaliana
  G1349 Genomic Sequence
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacaggtttttcgttttttgtttgttttccatttctctaattaaaactctctgtttctttcttcctgatgatgagtgttgtgttattgttgcagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggtaaacttataaatcattctgctcacttctacttagactgaatctgaaaaagaaacttgtggtgcgtttgtgaaaaatcaggaatggttcttatgaatgggaagaccatagatcagtcagagcttacaaaggaacagatggtggagcagctttctgtttcagtgcttgtgacgatgatgaatccagtggttacactcctgtatgcttccattatatcattcatcatcatgcaactaagcacacatacctctccgtatgttaactggatcatttcgtgctgtttcaggtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggtaagttaataaacaacttgtattatctgaaacttacattctgaatgattgaatatcgtatctcccaggagccactgctaa

SEQ ID NO: 1717 - DNA, 1414 bp, Arabidopsis thaliana
  G1349 DNA sequence used for BLAST
atggctagtcggagagaagtacggtgccggtgcggcagacggatgtgggttcaaccagacgcccgtaccgtccaatgctcaacctgccacaccgtcacgcagctctactcgctagtggacatagctcgcggtgcaaaccgcataattcatgggtttcaacagctacttagacaacaccaaccgcaacatcatgaacaacaacaacaacaaatgatggctcaaccgccaccacggctgcttgagcctcttccctcgccgtttgggaagaagagagcagttttatgcggcgtgaactataagggaaaaagttatagcttgaaaggttgcatcagtgatgctaagtccatgagatctttattggttcaacaaatgggtttccctattgactctattctcatgctcacaggtttttcgttttttgtttgttttccatttctctaattaaaactctctgtttctttcttcctgatgatgagtgttgtgttattgttgcagaagatgaagccagcccgcagagaataccgacgaagagaaacattaggaaggcgatgagatggttagttgaagggaacagagcaagggactcactagtgttccatttctctggtcatggatctcagcagaatgactacaacggagacgagatcgatggtcaagatgaagccttgtgccctttagaccatgaaacagaaggaaaaatcattgatgacgagattaaccggatactcgtgaggcctctcgtccatggagctaagcttcacgctgtcatcgacgcctgtaacagcgggactgtccttgatttacccttcatttgcaggatggagaggtaaacttataaatcattctgctcacttctacttagactgaatctgaaaaagaaacttgtggtgcgtttgtgaaaaatcaggaatggttcttatgaatgggaagaccatagatcagtcagagcttacaaaggaacagatggtggagcagctttctgtttcagtgcttgtgacgatgatgaatccagtggttacactcctgtatgcttccattatatcattcatcatcatgcaactaagcacacatacctctccgtatgttaactggatcatttcgtgctgtttcaggtgttcacggggaagaacacaggagccatgacttatagcttcataaaggcggtgaagacagctggaccagcacccacgtatggccacctgcttaaccttatgtgttctgcaatacgagaggcccagtctcgcctcgcctttaacggggactacacaagctctgatgcatccgcggtaagttaataaacaacttgtattatctgaaacttacattctgaatgattgaatatcgtatctcccaggagccactgctaacatcatctgaggaatttgacgtgtacgcgacaaagtttgtactctga

SEQ ID NO: 1718 - DNA, 1837 bp, Arabidopsis thaliana
  G1350 cDNA Sequence
tgacgaattaaagagtttttctgtatatctctctgtccacctgttttgtcttcttacttagaaactctctctttctctgtctttcaactaaaccaatatcagcatgatgatgccagatgatcatcatcccctctcatttcccagctatgtccttcaccaagaacacatcgctccaaatcctaaccctaaccctaatcctacctcctctaactcagccaagaggaagagaaatctcccgggaaatccagatccagatgcagaagtcatcgctctatcaccaaactccctcatgacaactaatcgattcatctgcgaggtttgcaacaaaggatttaagagagaccagaaccttcagcttcaccggagaggccataaccttccatggaagctaaagcaaaggacaaacaaggagcaagtgaagaaaaaagtgtacatctgtccagagaagacttgcgtacaccatgacccggcccgagcccttggtgacttaactggaattaagaagcatttcagcaggaaacatggtgaaaagaagtggaaatgtgacaagtgttccaagaaatatgctgtcatgtccgattggaaagctcatagcaagatttgtggtactaaagaatacagatgtgactgtggtaccctcttttccaggaaagatagtttcatcacacatagagcattctgtgacgctttagctgaagagagtgctagatttgtctcagttccaccagcacccgcatatttgaacaatgccctggatgtggaagtcaaccatggaaatatcaaccaaaatcatcaacaacgacagcttaatactacttcgtcacaattggaccaacctggttttaataccaatcgcaataacattgcctttttgggacaaaccttaccaaccaacgtttttgcgtcctcatcatctccatcacctcgtagtgcatccgactcccttcaaaatctatggcatttacaaggacaatcatctcaccaatggcttctcaacgaaaacaacaacaacaacaacaacattctccaaaggggaatctccaaaaatcaagaagaacatgagatgaagaatgtgattagtaatggttctttgttctcttcggaagcacgaaacaacactaataattataaccaaaacggtggacaaatagcatcaatgtcagccacggcattgctacaaaaggcagctcaaatgggatcaaagagatcatcatcaagctcaagcaatagcaagacttttggtctaatgacctctatcttcaacaacaaacaagcagagaatatcaaaactaaggaagttgatgaaagaggtttcacgagagactttcttggtgtgggaagtcaacaccgttcttggccgttattgatggtcaaccataatcttccagactcgtctcctccggcctccacggacggcacaccaaccgccgacatgaaccagtaatcttgtattgttcatgtatactataagagacgtgaagtatgagattcaagtgacgagaggatggtttaagcacggcgaagaaaacggtgaaatatgagacttttgactcaggagagaatctctgagtcaactcggtgttgcagatgggtccactcggttgatgaagatgggaagctattcgggtccacttctgcatgcatgacgaaacctctgaccatgcatgcacagcaaaacatacgctatgtcttttcttattcttcttattcttctttttctttttcttgtaattatttcatgttttaattttgaaagaccctaaaagaaactatgaaaagttcgtagtttgttactttttattttttcatcgtagaaaggttaaacttttttttgaaa

SEQ ID NO: 1719 - protein, 446 aa, Arabidopsis thaliana
  G1350 Amino Acid Sequence
MMMPDDHHPLSFPSYVLHQEHIAPNPNPNPNPTSSNSAKRKRNLPGNPDPDAEVIALSPNSLMTTNRFICEVCNKGFKRDQNLQLHRRGHNLPWKLKQRTNKEQVKKKVYICPEKTCVHHDPARALGDLTGIKKHFSRKHGEKKWKCDKCSKKYAVMSDWKAHSKICGTKEYRCDCGTLFSRKDSFITHRAFCDALAEESARFVSVPPAPAYLNNALDVEVNHGNINQNHQQRQLNTTSSQLDQPGFNTNRNNIAFLGQTLPTNVFASSSSPSPRSASDSLQNLWHLQGQSSHQWLLNENNNNNNNILQRGISKNQEEHEMKNVISNGSLFSSEARNNTNNYNQNGGQIASMSATALLQKAAQMGSKRSSSSSSNSKTFGLMTSIFNNKQAENIKTKEVDERGFTRDFLGVGSQHRSWPLLMVNHNLPDSSPPASTDGTPTADMNQ

SEQ ID NO: 1720 - DNA, 1695 bp, Arabidopsis thaliana
  G1350 DNA sequence used for BLAST
ttactggttcatgtcggcggttggtgtgccgtccgtggaggccggaggagacgagtctggaagattatggttgaccatcaataacggccaagaacggtgttgacttcccacaccaagaaagtctctcgtgaaacctctttcatcaacttccttagttttgatattctctgcttgtttgttgttgaagatagaggtcattagaccaaaagtcttgctattgcttgagcttgatgatgatctctttgatcccatttgagctgccttttgtagcaatgccgtggctgacattgatgctatttgtccaccgttttggttataattattagtgttgtttcgtgcttccgaagagaacaaagaaccattactaatcacattcttcatctcatgttcttcttgatttttggagattcccctttggagaatgttgttgttgttgttgttgttttcgttgagaagccattggtgagatgattgtccttgtaaatgccatagattttgaagggagtcggatgcactacgaggtgatggagatgatgaggacgcaaaaacgttggttggtaaggtttgtcccaaaaaggcaatgttattgcgattggtattaaaaccaggttggtccaattgtgacgaagtagtattaagctgtcgttgttgatgattttggttgatatttccatggttgacttccacatccagggcattgttcaaatatgcgggtgctggtggaactgagacaaatctagcactctcttcagctaaagcgtcacagaatgctctatgtgtgatgaaactatctttcctgttccaatccaatcatccaatatatactaattcaataaagagatcttagctgattttagttaaagccaattgaatttaaattaaactaaatgttgtatgacattgtttttcatgaaatttaaatttcgctctttaacaaaaaaatttgacttaaaaaagggtgttgtaatacatacctggaaaagagggtaccacagtcacatctgtattctttagtaccacaaatcttgctatgagctttccaatcggacatgacagcatatttcttggaacacttgtcacatttccacttcttttcaccatgtttcctgctgaaatgcttcttaattccagttaagtcaccaagggctcgggccgggtcatggtgtacgcaagtcttctctggacagatgtacacttttttcttcacttgctccttgtttgtcctttgctttagcttccatggaaggttatggcctctccggtgaagctgaaggttctggtctctcttaaatcctttgttgcaaacctcgcagatgaatcgattagttgtcatgagggagtttggtgatagagcgatgacttctgcatctggatctggtgtttaaatttcatttaccaaataagaaccaatgaattaatttatgataaataaaaaagagatccaaagctggaacaagaatattgttcttgatcgaaaaaaaaaaaacaaattagcaagaaattcatctattttatatgacaagtcctagatttagattaagtatttatatacatgcctggatttcccgggagatttctcttcctcttggctgagttagaggaggtaggattagggttagggttaggatttggagcgatgtgttcttggtgaaggacatagctgggaaatgagaggggatgatgatcatctggcat

SEQ ID NO: 1721 - DNA, 1056 bp, Arabidopsis thaliana
  G1351 cDNA Sequence
atggaagaagcagttgtaacgaggtattggtgtcatatgtgttctcaaactgtgaatccagtcatggaagctgagatcaaatgtcccttttgtcaaagtgggtttgttgaagaaatggaagatgacgacgatcatgattcttctgatccggctgatgttagagcaaacaactctctttgggcgcctatcttgatggaacttatgaatgatcctgtgcgtcgtaggagaaaccagagtgttgagtctgttgaagataatcaaaacgaggtacagaccgagaacaatgaagacgatggagaaaatgatttggattggcagcttcaagagattctcaggagaaggagaagacattccgctgctgttttgcagttgcttcaggggatacgagcagggttgtctgtagaatctgagagtactggtaatggaggtaataatccgggacgggtgatcttgatcaatacctccaatcagactatcacggttcaaaactctgctgatatggattctgtacctgctggttctttaggtgactatttcattggtcctggatttgaaatgttgcttcaacgtctagctgagaatgatcccaacagatatggaacacctcctgctaaaaaagaagctgtcgaggctttggctactgtgaaaatcgaagagactctgcaatgttcggtttgtttagatgattttgagattggaactgaggcaaagctgatgccctgtacgcacaagtttcatagtgactgcttgttaccatggcttgagcttcacagttcatgcccggtttgcagatatcagttacctgcagatgaagccaagactgattcagtaacaacaacgagcgataacaatggaagcagtagtgcttctgctacaaccagccatggagctgagaacagcgatggaaaccggcgccaagaagaagaagaagaagaagaagaggaggaggaggaggagaacgagaacaatgacggaagcggattctcgatcccgtggccgtttagcaccttgttctcctcgtcgcaagatagcaatgcaccaacggattctagttaa

SEQ ID NO: 1722 - protein, 351 aa, Arabidopsis thaliana
  G1351 Amino Acid Sequence
MEEAVVTRYWCHMCSQTVNPVMEAEIKCPFCQSGFVEEMEDDDDHDSSDPADVRANNSLWAPILMELMNDPVRRRRNQSVESVEDNQNEVQTENNEDDGENDLDWQLQEILRRRRRHSAAVLQLLQGIRAGLSVESESTGNGGNNPGRVILINTSNQTITVQNSADMDSVPAGSLGDYFIGPGFEMLLQRLAENDPNRYGTPPAKKEAVEALATVKIEETLQCSVCLDDFEIGTEAKLMPCTHKFHSDCLLPWLELHSSCPVCRYQLPADEAKTDSVTTTSDNNGSSSASATTSHGAENSDGNRRQEEEEEEEEEEEEENENNDGSGFSIPWPFSTLFSSSQDSNAPTDSS

SEQ ID NO: 1723 - DNA, 1056 bp, Arabidopsis thaliana; identical to SEQ ID NO: 1721
  G1351 Genomic Sequence

SEQ ID NO: 1724 - DNA, 1003 bp, Arabidopsis thaliana
  misc_feature (466)..(466): n is a, c, g, or t
  misc_feature (476)..(476): n is a, c, g, or t
  misc_feature (483)..(483): n is a, c, g, or t
  misc_feature (494)..(494): n is a, c, g, or t
  misc_feature (504)..(504): n is a, c, g, or t
  misc_feature (546)..(546): n is a, c, g, or t
  misc_feature (563)..(563): n is a, c, g, or t
  misc_feature (627)..(627): n is a, c, g, or t
  misc_feature (652)..(652): n is a, c, g, or t
  misc_feature (658)..(658): n is a, c, g, or t
  misc_feature (668)..(668): n is a, c, g, or t
  misc_feature (683)..(683): n is a, c, g, or t
  misc_feature (693)..(693): n is a, c, g, or t
  misc_feature (707)..(707): n is a, c, g, or t
  misc_feature (712)..(712): n is a, c, g, or t
  misc_feature (716)..(717): n is a, c, g, or t
  misc_feature (720)..(720): n is a, c, g, or t
  misc_feature (742)..(742): n is a, c, g, or t
  misc_feature (751)..(751): n is a, c, g, or t
  misc_feature (757)..(757): n is a, c, g, or t
  misc_feature (768)..(768): n is a, c, g, or t
  misc_feature (778)..(778): n is a, c, g, or t
  misc_feature (785)..(785): n is a, c, g, or t
  misc_feature (787)..(787): n is a, c, g, or t
  misc_feature (793)..(795): n is a, c, g, or t
  misc_feature (799)..(800): n is a, c, g, or t
  misc_feature (824)..(824): n is a, c, g, or t
  misc_feature (828)..(830): n is a, c, g, or t
  misc_feature (840)..(840): n is a, c, g, or t
  misc_feature (843)..(843): n is a, c, g, or t
  misc_feature (848)..(848): n is a, c, g, or t
  misc_feature (855)..(855): n is a, c, g, or t
  misc_feature (857)..(857): n is a, c, g, or t
  misc_feature (860)..(860): n is a, c, g, or t
  misc_feature (864)..(864): n is a, c, g, or t
  misc_feature (870)..(870): n is a, c, g, or t
  misc_feature (872)..(872): n is a, c, g, or t
  misc_feature (874)..(874): n is a, c, g, or t
  misc_feature (881)..(881): n is a, c, g, or t
  misc_feature (890)..(890): n is a, c, g, or t
  misc_feature (898)..(898): n is a, c, g, or t
  misc_feature (914)..(914): n is a, c, g, or t
  misc_feature (923)..(923): n is a, c, g, or t
  misc_feature (933)..(933): n is a, c, g, or t
  misc_feature (938)..(939): n is a, c, g, or t
  misc_feature (953)..(953): n is a, c, g, or t
  misc_feature (969)..(969): n is a, c, g, or t
  misc_feature (974)..(974): n is a, c, g, or t
  misc_feature (985)..(985): n is a, c, g, or t
  misc_feature (998)..(998): n is a, c, g, or t
  G1351 DNA sequence used for BLAST
ctgctatcgaacaacaagactcaaaaggtagaaagaatcggacatggaagaagcagttgtaaccgaggtattggtgtcatatgtgttctcaaactgtgaatccagtcatggaagctgagatcaaatgtcccttttgtcaaagtgggtttgttgaagaaatggaagatgaccgacgatcatgattcttctgatccggctgatgttagagcaaacaactctctttgggcgcctatcttgatggaacttatgaatgatcctgtgcgtcgtaggagaaaccagagtgttgagtctgttgaagataatcaaaacgaggtcagacccgagaacaatgaagacgatggagaaaatgatttggattggcagcttcaagagattctcaggagaaggagaagacattccgctgctggttttgcagttgcttcaggggataccagcaggggttggctgtagaatctgagagtctggnaatgggaggnaataatnccgggacgggngatcttgacnaatacctccaatcaggctatcacgggtcaaaactctgctganatggatctgaccctgcngggtctttagggactatttaatgggcccggatttgaaaggtgctcaacgctaactgagaaagancccacaaaaatggacacctctgctnaaaaanaagctgccgngctttgcttctgggnaaaacgaaanaccttccaaggtcnggttngttnnaanaatttggaaatggaccggggcnaacttgagnccctgnccccaaagttnaaagggccgnttgtacncngggttnnnggtnnaaaataaagccccggttggggaantaannnccccccgggngangccanatggttntntancccncccggngnanaaggggnggggggggngttttttnaacccccctggcgtgnaccaaggtngaaaacgccnccaannaaaaaaaaacaaangggcggggggggcccnaaaanactgcgtgttnctccccccccctnaaatt

SEQ ID NO: 1725 - DNA, 1001 bp, Arabidopsis thaliana
  G1352 cDNA Sequence
gcgcgattaaaaactctcaacttttctctcaaatttctgatcctttgatccaacagttagaagaagattcatctgatcatggccctcgaagcgatgaacactccaacttcttctttcaccagaatcgaaacgaaagaagatttgatgaacgacgccgttttcattgagccgtggcttaaacgcaaacgctccaaacgtcagcgttctcacagcccttcttcgtcttcttcctcaccgcctcgatctcgacccaaatcccagaatcaagatcttacggaagaagagtatctcgctctttgtctcctcatgctcgctaaagatcaaccgtcgcaaacgcgatttcatcaacagtcgcaatcgttaacgccgccgccagaatcaaagaaccttccgtacaagtgtaacgtctgtgaaaaagcgtttccttcctatcaggctttaggcggtcacaaagcaagtcaccgaatcaaaccaccaaccgtaatctcaacaaccgccgatgattcaacagctccgaccatctccatcgtcgccggagaaaaacatccgattgctgcctccggaaagatccacgagtgttcaatctgtcataaagtgtttccgacgggtcaagctttaggcggtcacaaacgttgtcactacgaaggcaacctcggcggcggaggaggaggaggaagcaaatcaatcagtcacagtggaagcgtgtcgagcacggtatcggaagaaaggagccaccgtggattcatcgatctaaacctaccggcgttacctgaactcagccttcatcacaatccaatcgtcgacgaagagatcttgagtccgttgaccggtaaaaaaccgcttttgttgaccgatcacgaccaagtcatcaagaaagaagatttatctttaaaaatctaatactcgactattaattcttgtgtgatttttttcgttacaaccatagtttcattttcatttttttagttacaaatttttaattgttctgatttggattgaaa

SEQ ID NO: 1726 - protein, 273 aa, Arabidopsis thaliana
  G1352 Amino Acid Sequence
MALEAMNTPTSSFTRIETKEDLMNDAVFIEPWLKRKRSKRQRSHSPSSSSSSPPRSRPKSQNQDLTEEEYLALCLLMLAKDQPSQTRFHQQSQSLTPPPESKNLPYKCNVCEKAFPSYQALGGHKASHRIKPPTVISTTADDSTAPTISIVAGEKHPIAASGKIHECSICHKVFPTGQALGGHKRCHYEGNLGGGGGGGSKSISHSGSVSSTVSEERSHRGFIDLNLPALPELSLHHNPIVDEEILSPLTGKKPLLLTDHDQVIKKEDLSLKI

SEQ ID NO: 1727 - DNA, 822 bp, Arabidopsis thaliana
  G1352 DNA sequence used for BLAST
ttagatttttaaagataaatcttctttcttgatgacttggtcgtgatcggtcaacaaaagcggttttttaccggtcaacggactcaagatctcttcgtcgacgattggattgtgatgaaggctgagttcaggtaacgccggtaggtttagatcgatgaatccacggtggctcctttcttccgataccgtgctcgacacgcttccactgtgactgattgatttgcttcctcctcctcctccgccgccgaggttgccttcgtagtgacaacgtttgtgaccgcctaaagcttgacccgtcggaaacactttatgacagattgaacactcgtggatctttccggaggcagcaatcggatgtttttctccggcgacgatggagatggtcggagctgttgaatcatcggcggttgttgagattacggttggtggtttgattcggtgacttgctttgtgaccgcctaaagcctgataggaaggaaacgctttttcacagacgttacacttgtacggaaggttctttgattctggcggcggcgttaacgattgcgactgttgatgaaatcgcgtttgcgacggttgatctttagcgagcatgaggagacaaagagcgagatactcttcttccgtaagatcttgattctgggatttgggtcgagatcgaggcggtgaggaagaagacgaagaagggctgtgagaacgctgacgtttggagcgtttgcgtttaagccacggctcaatgaaaacggcgtcgttcatcaaatcttctttcgtttcgattctggtgaaagaagaagttggagtgttcatcgcttcgagggccat

SEQ ID NO: 1728 - DNA, 1206 bp, Arabidopsis thaliana
  G1355 cDNA Sequence
cgtcgacccgtcacatactcgatcaattataattatatattcggctgcgaagatttacaagaaataatggagccaatggaatcttgtagcgttcctccaggatttaggttccatccgacggacgaagagcttgtcgggtactatctaaggaagaaaatcgcatcgcaaaagattgatctcgacgtcatcagagacatcgatctctacagaatagaaccatgggatctacaagaacaatgtcgaatcggttatgaggaacaaaatgaatggtatttttttagtcacaaggacaagaaatatccaacggggacaagaactaatagagcgaccatggctggattttggaaagccacgggaagagacaaagctgtttacgacaaaacaaaactaattggtatgaggaaaacacttgtgttctacaaaggacgtgcacctaatggcaagaaatccgattggatcatgcatgagtaccggctcgagtcagatgagaatgcaccgccccaggaagaaggatgggtggtttgtagagcattcaaaaaaagagctacagggcaagccaagaacacggaaacttggagctcaagttacttttacgatgaagttgcaccgaatggagttaactcggttatggaccccattgattacatatctaagcagcaacataacatttttgggaaaggtttgatgtgtaagcaagaactagaaggaatggttgatggtataaactatatacaatcgaatcaattcattcagctcccacaactccaaagcccttctctcccgctgatgaaaagaccttcaagctcgatgtccataacatcaatggataacaattacaactataaactcccattagcggatgaagaaagcttcgagtcattcataagaggagaggatagaaggaagaagaaaaagcaagtaatgatgacgggaaattggagagagttagacaagtttgttgcttcacaacttatgagccaagaagacaatggaacttcaagtttcgcaggtcatcatatagttaatgaagataaaaacaacaatgatgtggagatggattcgtcaatgtttttgagcgaaagagaagaagaaaacaggttcgtcagtgaattcttgagtacaaactcggattatgatattgggatttgcgtatttgataattgaatgaaactacatagatggcatgtgagatttgttggtacgtgc

SEQ ID NO: 1729 - protein, 365 aa, Arabidopsis thaliana
  G1355 Amino Acid Sequence
MEPMESCSVPPGFRFHPTDEELVGYYLRKKIASQKIDLDVIRDIDLYRIEPWDLQEQCRIGYEEQNEWYFFSHKDKKYPTGTRTNRATMAGFWKATGRDKAVYDKTKLIGMRKTLVFYKGRAPNGKKSDWIMHEYRLESDENAPPQEEGWVVCRAFKKRATGQAKNTETWSSSYFYDEVAPNGVNSVMDPIDYISKQQHNIFGKGLMCKQELEGMVDGINYIQSNQFIQLPQLQSPSLPLMKRPSSSMSITSMDNNYNYKLPLADEESFESFIRGEDRRKKKKQVMMTGNWRELDKFVASQLMSQEDNGTSSFAGHHIVNEDKNNNDVEMDSSMFLSEREEENRFVSEFLSTNSDYDIGICVFDN

SEQ ID NO: 1730 - DNA, 1905 bp, Arabidopsis thaliana
  G1355 Genomic Sequence
tcaattatcaaatacgcaaatcccaatatcataatccgagtttgtactcaagaattcactgacgaacctgttttcttcttctctttcgctcaaaaacattgacgaatccatctccacatcattgttgtttttatcttcattaactatatgatgacctgcgaaacttgaagttccattgtcttcttggctcataagttgtgaagcaacaaacttgtctaactctctccaatttcccgtcatcattacttgctttttcttcttccttctatcctctcctcttatgaatgactcgaagctttcttcatccgctaatgggagtttatagttgtaattgttatccattgatgttatggacatcgagcttgaaggtcttttcatcagcgggagagaagggctttggagttgtgggagctgaatgaattgattcgattgtatatagtttataccatcaaccattccttctagttcttgcttacacatcaaacctttcccaaaaatgttatgttgctgcttagatatgtaatcaatggggtccataaccgagttaactccattcggtgcaacttcatcgtaaaagtaacttgagctccaagtttccgtgttcttggcttgccctgtagctctttttttgaatgctctacaaaccacccatccttcttcctaaaacacatatatgcacaaaaatgatcataagaagacatgacatgtaaatagaatctttggcttgaattgatgtttcaaaaattggtaaagaatcatataatacataaggccaatgcaaacaaaaagatggagaaaaggcagttagattttagtgaaacacacataaggacatgcttgaaaagtgtgagaccaaaaataagaaagctagtgaaatgtataggtacatactcatgcaatctaatagagtttcacttttgaactttattgactttaagatattgaaaaaacaagcacaactataatcataaacaatatatactacaaacatatatagatcattttctatagaggaaattgctagcgtacaaatatatatgcgaaagattactacaaaagggattaaataatttataattgttataaacgagacaaaagtttacatgtttactacttcaaaaggaaatgtgattgaacttttctgtttttggttagtggaaaactgtaaaattctgcaatggtcaaaatatttataataaaaattgacgtgagactgaaatttgatactagtttaggagagacttttactttcttttttctgattgaatataagtattaatggactttcacctaaaagttagcatgtgcctcacgaaagagcccaagagacaagaagccctaattaaaacaaaaatgttttgtccccaccaaagtagaaacacaagtacctggggcggtgcattctcatctgactcgagccggtactcatgcatgatccaatcggatttcttgccattaggtgcacgtcctttgtagaacacaagtgttttcctcataccaattagttttgttttgtcgtaaacagctttgtctcttcccgtggctttccaaaatccagccatggtcgctctattagttcttgtccccgttggatatttcttgtccttgtgactaaaaaaataccattcattttgttcctcataaccgattcgacattgttctgtaacatttaaaatttaaggtgataatcaataaaaccttaaccaaagtaaaatatctcacggtgttcggtaagtaaccttgtagatcccatggttctattctgtagagatcgatgtctctgatgacgtcgagatcaatcttttgcgatgcgattttcttccttagatagtacccgacaagctcttcgtccgtcggatggaacctaaatcctggaggaacgctacaagattccattggctccat

SEQ ID NO: 1731 - DNA, 1905 bp, Arabidopsis thaliana; identical to SEQ ID NO: 1730
  G1355 DNA sequence used for BLAST

SEQ ID NO: 1732 - DNA, 1010 bp, Arabidopsis thaliana
  G1363 cDNA Sequence
cgtctacctactatggtctggagattagttcgtttattgaactaatgttttagacaatgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtgagagagctccgcaagtggtggatgaggc

SEQ ID NO: 1733 - protein, 308 aa, Arabidopsis thaliana
  G1363 Amino Acid Sequence
MQEFHSSKDSLPCPATSWDNSVFTNSNVQGSSSLTDNNTLSLTMEMKQTGFQMQHYDSSSTQSTGGESYSEVASLSEPTNRYGHNIVVTHLSGYKENPENPIGSHSISKVSQDSVVLPIEAASWPLHGNVTPHFNGFLSFPYASQHTVQHPQIRGLVPSRMPLPHNIPENEPIFVNAKQYQAILRRRERRAKLEAQNKLIKVRKPYLHESRHLHALKRVRGSGGRFLNTKKHQESNSSLSPPFLIPPHVFKNSPGKFRQMDISRGGVVSSVSTTSCSDITGNNNDMFQQNPQFRFSGYPSNHHVSVLM

SEQ ID NO: 1734 - DNA, 1334 bp, Arabidopsis thaliana
  G1363 Genomic Sequence
atgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggtccaccactttttaacctttttcgcctgagtaagagttcacattgctgcgtcaactgcatttaattttagcttatctatggtttcttgttttggtgcaggttacaaagaaaacccggaaaatcctattggaagtcattcgatatcaaaggtgtctcaagattcagtggttcttcctattgaggttaattattagactatcatctttgaccttattataaaccttgtagtagttcaagatgagactgagtttaaagctgaatactatcttaatgatgtctatatatgctcacaggcggcttcttggcctttacacggcaatgtaacgccacatttcaatggtttcttgtcttttccttatgcatcacaacacacggtaatacacaattgtaacatttcaagataatactgtttcttgtatctttatgaaagtatttgttatggaaatctttgcaggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaagtatgtttgtttatctatattgcaccactctgataaatagaattatatgcagaaagtttcagttattatgtcaagagtcttgactcaagaccaattttttgtatgaaactatgcagccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtga

SEQ ID NO: 1735 - DNA, 1334 bp, Arabidopsis thaliana; identical to SEQ ID NO: 1734
  G1363 DNA sequence used for BLAST

SEQ ID NO: 1736 - DNA, 757 bp, Arabidopsis thaliana
  G1366 cDNA Sequence
ctaatctcttctcttctcttaaaatcaaacgtaatcataaataaagatcttcttgtttaatttctcttgatcctcgcaaaatcacagattcttgaaattcttttttcttgtcttgaaattcttgagttcttgagttatgaaaagacaatggacagagttatgaaatgataaatctcaaccaattccttgtttatcattctatatcagttgtgattcttcattggttttacgttatctcttgaacaaaaaaacatggcaaacgcagagaagacaagttcaggttccgacatagatgagaagaaaagaaaacgcaagttatcaaaccgcgaatctgcaaggaggtcgcgtttgaagaaacagaagttaatggaagacacgattcatgagatctccagtcttgaacgacgaatcaaagagaacagtgagagatgtcgagctgtaaaacagaggcttgactcggtcgaaacggagaacgcgggtcttagatcggagaagatttggctctcgagttacgttagcgatttagagaatatgattgctacgacgagtttaacgctgacgcagagtggtggtggcgattgtgtcgacgatcagaacgcaaacgcgggaatagcggttggagattgtagacgtacaccgtggaaattgagttgtggttctctacaaccaatggcgtcctttaagacatgagatttgtgtattagtgtgtgttttactttggtcattttatagtttttgtaatctttttatatcgaat

SEQ ID NO: 1737 - protein, 145 aa, Arabidopsis thaliana
  G1366 Amino Acid Sequence
MANAEKTSSGSDIDEKKRKRKLSNRESARRSRLKKQKLMEDTIHEISSLERRIKENSERCRAVKQRLDSVETENAGLRSEKIWLSSYVSDLENMIATTSLTLTQSGGGDCVDDQNANAGIAVGDCRRTPWKLSCGSLQPMASFKT

SEQ ID NO: 1738 - DNA, 438 bp, Arabidopsis thaliana
  G1366 Genomic Sequence
atggcaaacgcagagaagacaagttcaggttccgacatagatgagaagaaaagaaaacgcaagttatcaaaccgcgaatctgcaaggaggtcgcgtttgaagaaacagaagttaatggaagacacgattcatgagatctccagtcttgaacgacgaatcaaagagaacagtgagagatgtcgagctgtaaaacagaggcttgactcggtcgaaacggagaacgcgggtcttagatcggagaagatttggctctcgagttacgttagcgatttagagaatatgattgctacgacgagtttaacgctgacgcagagtggtggtggcgattgtgtcgacgatcagaacgcaaacgcgggaatagcggttggagattgtagacgtacaccgtggaaattgagttgtggttctctacaaccaatggcgtcctttaagacatga

SEQ ID NO: 1739 - DNA, 438 bp, Arabidopsis thaliana; identical to SEQ ID NO: 1738
  G1366 DNA sequence used for BLAST

SEQ ID NO: 1740 - DNA, 1964 bp, Arabidopsis thaliana
  G1367 cDNA Sequence
tccttccacaaaacttttttaattttatctgaaaaattaaaacaaccgaaacaaaaaaaaaaaactaaaaatcaaaaatctcatcaccttccttgctctgtattttttctctctcactaaatcctccatggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaagaatgcggtgtcagtgggagcttctggacgacaagatggtgactatggagaactgaagaagaagtttgagttgtttcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaaagataaagccttgacataaaaagctagcaagtggtgggtttacttgttgtgtgttacatgaaatttttaatcttataagggtgtttgcaggagaaaaacaaaaagaacaatgtgatgaactgatgatgatgattgtgtctctaaccaaacaacaaggagaggtagggtaatgtctgtaaagtgaattaggatgttaccattgttcatgcttcccatctctctccatcgtccatatctgtgtaggcagctttgttctttgttccctcgtgttttttttagactgttgtgtctcttattctattttgtctccttaggctttttaggagttgttgttgatgtttatcaaaaacgcttatgtaatttttatgaccacttctactttttatgatggtttctt

SEQ ID NO: 1741 - protein, 479 aa, Arabidopsis thaliana
  G1367 Amino Acid Sequence
MDPSLSATNDPHHPPPPQFTSFPPFTNTNPFASPNHPFFTGPTAVAPPNNIHLYQAAPPQQPQTSPVPPHPSISHPPYSDMICTAIAALNEPDGSSKQAISRYIERIYTGIPTAHGALLTHHLKTLKTSGILVMVKKSYKLASTPPPPPPTSVAPSLEPPRSDFIVNENQPLPDPVLASSTPQTIKRGRGRPPKAKPDVVQPQPLTNGKLTWEQSELPVSRPEEIQIQPPQLPLQPQQPVKRPPGRPRKDGTSPTVKPAASVSGGVETVKRRGRPPSGRAAGRERKPIVVSAPASVFPYVANGGVRRRGRPKRVDAGGASSVAPPPPPPTNVESGGEEVAVKKRGRGRPPKIGGVIRKPMKPMRSFARTGKPVGRPRKNAVSVGASGRQDGDYGELKKKFELFQARAKDIVIVLKSEIGGSGNQAVVQAIQDLEGIAETTNEPKHMEEVQLPDEEHLETEPEAEGQGQTEAEAMQEALF

SEQ ID NO: 1742 - DNA, 2154 bp, Arabidopsis thaliana
  G1367 Genomic Sequence
atggatccttctctctctgcaaccaatgatcctcatcatcctcctcctcctcagttcacatctttccctcctttcaccaacaccaaccccttcgcctctccaaaccaccccttcttcaccggacccaccgccgtcgcgccgccaaacaacatccatctctatcaagcagctcctccgcagcagccacaaacatctccagttcctcctcatccatctatttcccaccctccttactctgacgtaagctcttcttagctcattcttacattttgactttaaagttagggtttttaatttccactcacttttttttttcgttgattagatgatttgcacggcgattgcagcgttaaacgaaccagatgggtcaagcaagcaagctatttcgaggtacatagagagaatttacactgggattcctactgctcatggagctttgttgacacaccatctcaagactttgaagaccagtgggattcttgtcatggttaagaaatcttacaagcttgcttctactcctcctcctcctcctcctactagtgtagctcctagtcttgaacctcccagatctgatttcatagtcaacgagaaccaacctttacctgatccggttttggcttcttctactcctcagactattaaacgtggtcgtggtcgacctccaaaagctaaaccagatgttgttcaacctcaacctctgactaatggaaaactcacctgggaacagagtgaattacctgtctctcgaccagaggagatacagatacagccgccacagttaccgttacagccacagcagccggttaagagaccgccgggtcgtcctagaaaagatggaacttcgccgacggtgaagccagctgcttctgtttccggtggtgtggagactgtgaaacgaagaggtagacctccgagtggaagagctgctgggagggagagaaagcctatagtagtctcagctccagcttcagtgttcccgtatgttgctaatggtggtgttagacgccgagggagaccaaagagagttgacgctggtggtgcttcctctgttgctccaccaccaccaccaccaactaacgtagagagtggaggagaggaggttgcagtcaagaaacgaggaagaggacggcctcctaagattggaggtgttatcaggaagcctatgaagccgatgagaagctttgctcgtactggaaaacccgtaggaagacccagaaaggtaaaatatcattcctttttgtctctgcgattacacagtgattatagagaacttgaatatttctagtcaaatagataagagaataaaagttggaacttttgtcttgtgaataaatgtcactttccattctcaacattgtctctttcgagcgtgtgtgtggagactagagagtatctaactaaataaattctagagtttaatttatattcgtgtctctgcttttggcctatacttaatctggttttgtggtgtactattaatctaagatatctctttgtttggtaatcaagagcaacttggtaggtggctcgctttagcaaccaataattgttcagttgaagtgtgagaattacatatgaacttatcttttgagacagacatcttatcaagttttgtctgttttaagcagaaatttagttaattcagtcaaagttcaagagtttgtgtatttccaagtccactagaatttctttgtctattatattgatgagttagttatctaattacatttatattattgccatttataaacatagaatgcggtgtcagtgggagcttctggacgacaagatggtgactatggagaactgaagaagaagtttgagttgtttgtaagtaatctaatgaacagaaacacaatatggtccgtccttggttttgatacttaattgcttatgcttggttttgatatctcatttatgcagcaagcgagagctaaggatattgtaattgtgttgaaatccgagataggaggaagtggaaatcaagcagtggttcaagccatacaggacctggaagggatagcagagacaacaaacgagccaaagcacatggaagaagtgcagctgccagacgaggaacaccttgaaaccgaaccagaagcagagggtcaaggacagacagaagcagaggcaatgcaagaagctctgttctaa

SEQ ID NO: 1743 - DNA, 2154 bp, Arabidopsis thaliana
  G1367 DNA sequence used for BLAST
ttagaacagagcttcttgcattgcctctgcttctgtctgtccttgaccctctgcttctggttcggtttcaaggtgttcctcgtctggcagctgcacttcttccatgtgctttggctcgtttgttgtctctgctatcccttccaggtcctgtatggcttgaaccactgcttgatttccacttcctcctatctcggatttcaacacaattacaatatccttagctctcgcttgctgcataaatgagatatcaaaaccaagcataagcaattaagtatcaaaaccaaggacggaccatattgtgtttctgttcattagattacttacaaacaactcaaacttcttcttcagttctccatagtcaccatcttgtcgtccagaagctcccactgacaccgcattctatgtttataaatggcaataatataaatgtaattagataactaactcatcaatataatagacaaagaaattctagtggacttggaaatacacaaactcttgaactttgactgaattaactaaatttctgcttaaaacagacaaaacttgataagatgtctgtctcaaaagataagttcatatgtaattctcacacttcaactgaacaattattggttgctaaagcgagccacctaccaagttgctcttgattaccaaacaaagagatatcttagattaatagtacaccacaaaaccagattaagtataggccaaaagcagagacacgaatataaattaaactctagaatttatttagttagatactctctagtctccacacacacgctcgaaagagacaatgttgagaatggaaagtgacatttattcacaagacaaaagttccaacttttattctcttatctatttgactagaaatattcaagttctctataatcactgtgtaatcgcagagacaaaaaggaatgatattttacctttctgggtcttcctacgggttttccagtacgagcaaagcttctcatcggcttcataggcttcctgataacacctccaatcttaggaggccgtcctcttcctcgtttcttgactgcaacctcctctcctccactctctacgttagttggtggtggtggtggtggagcaacagaggaagcaccaccagcgtcaactctctttggtctccctcggcgtctaacaccaccattagcaacatacgggaacactgaagctggagctgagactactataggctttctctccctcccagcagctcttccactcggaggtctacctcttcgtttcacagtctccacaccaccggaaacagaagcagctggcttcaccgtcggcgaagttccatcttttctaggacgacccggcggtctcttaaccggctgctgtggctgtaacggtaactgtggcggctgtatctgtatctcctctggtcgagagacaggtaattcactctgttcccaggtgagttttccattagtcagaggttgaggttgaacaacatctggtttagcttttggaggtcgaccacgaccacgtttaatagtctgaggagtagaagaagccaaaaccggatcaggtaaaggttggttctcgttgactatgaaatcagatctgggaggttcaagactaggagctacactagtaggaggaggaggaggaggagtagaagcaagcttgtaagatttcttaaccatgacaagaatcccactggtcttcaaagtcttgagatggtgtgtcaacaaagctccatgagcagtaggaatcccagtgtaaattctctctatgtacctcgaaatagcttgcttgcttgacccatctggttcgtttaacgctgcaatcgccgtgcaaatcatctaatcaacgaaaaaaaaaagtgagtggaaattaaaaaccctaactttaaagtcaaaatgtaagaatgagctaagaagagcttacgtcagagtaaggagggtgggaaatagatggatgaggaggaactggagatgtttgtggctgctgcggaggagctgcttgatagagatggatgttgtttggcggcgcgacggcggtgggtccggtgaagaaggggtggtttggagaggcgaaggggttggtgttggtgaaaggagggaaagatgtgaactgaggaggaggaggatgatgaggatcattggttgcagagagagaaggatccat

SEQ ID NO: 1744 - DNA, 1132 bp, Arabidopsis thaliana
  G1383 cDNA Sequence
atctcactcaaaagaaaatctaagaaaagattcttaattttctgaagtgaatgcaaagatgatgatggaagagaaacttgtgatcaacgaattggaactagggaaagagcttgctaaccgattgatgaacaatctcaaacacacttcttctgtcgattccaacaaaaccttgatctctgatatcctccgtatttaccagaatgccattttcatgttgagcttcaaccaagacaagaacatccttaagcgaagccttgagatcgatggaaaagattctaaaaacgtcttcaaaaagaggaaagtatcggagaagaacacagagaaagttaaggtttttgttgcaacagaacaagaaaatggctctattgatgatggtcactgctggagaaaatatgggcaaaaagagattcatggatccaaaaatcctagagcatattacagatgcacgcatcgattcacacaagactgtttagcagtgaagcaagttcagaaatcagacacagatccttcccttttcgaagtgaagtatctcggaaaccacacttgtaacaacatcacatccccgaagacgacgacgaacttctctgtttcattgacgaacacgaacatctttgaaggaaacagagtacatgttacagagcaatcggaagacatgaaaccgaccaagtccgaagaagtgatgataagccttgaagatctggagaacaagaagaacattttcagaacgttttctttctctaaccatgagattgagaacggtgtgtggaaaagtaaccttttcttgggaaatttcgtggaagatctttctcctgcaacatcagggtctgcaattaccagcgaggttttatctgcacctgctgctgttgagaattccgaaactgcagattcgtatttctcgtctttggacaatattatcgatttcggacaggattggttgtggtcgtagctttgaataattgatttggtgaatgtaatgtctctctcttaatggcagtaattatagatggtcagtttaatttaagggttattagttattacttattagtatagtaaaaattatttttgccgatggataaaaattggcttataggactaaagttacatgattttggcctaaaaaaaaaaaaaaaaa

SEQ ID NO: 1745 - protein, 295 aa, Arabidopsis thaliana
  G1383 Amino Acid Sequence
MMMEEKLVINELELGKELANRLMNNLKHTSSVDSNKTLISDILRIYQNAIFMLSFNQDKNILKRSLEIDGKDSKNVFKKRKVSEKNTEKVKVFVATEQENGSIDDGHCWRKYGQKEIHGSKNPRAYYRCTHRFTQDCLAVKQVQKSDTDPSLFEVKYLGNHTCNNITSPKTTTNFSVSLTNTNIFEGNRVHVTEQSEDMKPTKSEEVMISLEDLENKKNIFRTFSFSNHEIENGVWKSNLFLGNFVEDLSPATSGSAITSEVLSAPAAVENSETADSYFSSLDNIIDFGQDWLWS

SEQ ID NO: 1746 - DNA, 1079 bp, Arabidopsis thaliana
  G1383 Genomic Sequence
atgatgatggaagagaaacttgtgatcaacgaattggaactagggaaagagcttgctaaccgattgatgaacaatctcaaacacacttcttctgtcgattccaacaaaaccttgatctctgatatcctccgtatttaccagaatgccattttcatgttgagcttcaaccaagacaagaacatccttaagcgaagccttgagatcgatggaaaagattctaaaaacgtcttcaaaaagaggtaaattgagctaaaagattggttttttgtctctctttcagttccaaactgtgctcatgtgtctgattcctctgtttttttttttggtgattttcaggaaagtatcggagaagaacacagagaaagttaaggtttttgttgcaacagaacaagaaaatggctctattgatgatggtcactgctggagaaaatatgggcaaaaagagattcatggatccaaaaatcctaggtgattatcattcattcatcatctgggaatttcaaagttttaatttttcttttgctatatttgctaaatcctatgtctctgtttttgtttacagagcatattacagatgcacgcatcgattcacacaagactgtttagcagtgaagcaagttcagaaatcagacacagatccttcccttttcgaagtgaagtatctcggaaaccacacttgtaacaacatcacatccccgaagacgacgacgaacttctctgtttcattgacgaacacgaacatctttgaaggaaacagagtacatgttacagagcaatcggaagacatgaaaccgaccaagtccgaagaagtgatgataagccttgaagatctggagaacaagaagaacattttcagaacgttttctttctctaaccatgagattgagaacggtgtgtggaaaagtaaccttttcttgggaaatttcgtggaagatctttctcctgcaacatcagggtctgcaattaccagcgaggttttatctgcacctgctgctgttgagaattccgaaactgcagattcgtatttctcgtctttggacaatattatcgatttcggacaggattggttgtggtcgtag

SEQ ID NO: 1747 - DNA, 1079 bp, Arabidopsis thaliana
  G1383 DNA sequence used for BLAST
ctacgaccacaaccaatcctgtccgaaatcgataatattgtccaaagacgagaaatacgaatctgcagtttcggaattctcaacagcagcaggtgcagataaaacctcgctggtaattgcagaccctgatgttgcaggagaaagatcttccacgaaatttcccaagaaaaggttacttttccacacaccgttctcaatctcatggttagagaaagaaaacgttctgaaaatgttcttcttgttctccagatcttcaaggcttatcatcacttcttcggacttggtcggtttcatgtcttccgattgctctgtaacatgtactctgtttccttcaaagatgttcgtgttcgtcaatgaaacagagaagttcgtcgtcgtcttcggggatgtgatgttgttacaagtgtggtttccgagatacttcacttcgaaaagggaaggatctgtgtctgatttctgaacttgcttcactgctaaacagtcttgtgtgaatcgatgcgtgcatctgtaatatgctctgtaaacaaaaacagagacataggatttagcaaatatagcaaaagaaaaattaaaactttgaaattcccagatgatgaatgaatgataatcacctaggatttttggatccatgaatctctttttgcccatattttctccagcagtgaccatcatcaatagagccattttcttgttctgttgcaacaaaaaccttaactttctctgtgttcttctccgatactttcctgaaaatcaccaaaaaaaaaaacagaggaatcagacacatgagcacagtttggaactgaaagagagacaaaaaaccaatcttttagctcaatttacctctttttgaagacgtttttagaatcttttccatcgatctcaaggcttcgcttaaggatgttcttgtcttggttgaagctcaacatgaaaatggcattctggtaaatacggaggatatcagagatcaaggttttgttggaatcgacagaagaagtgtgtttgagattgttcatcaatcggttagcaagctctttccctagttccaattcgttgatcacaagtttctcttccatcatcat

SEQ ID NO: 1748 - DNA, 1258 bp, Arabidopsis thaliana
  G1385 cDNA Sequence
tgtttctcccgctcttgctctgttttctcaaagacaaaagaggacatcgtcgttgactcctcttctctatggctactgctaagaacaagggaaaatcaatcagggtccttggtaccagtgaagcagagaaaaaggatgagatggagttggaggaggagttccagtttagtagcggcaagtataaagattcgggtcctggctcggacatgtggttaggagatgcttcctctacgtctccaagaagtcttaggaagactagaacctttgaccgacataatccctatctcgtatcttcttatgctactcctcagccgccaacaacaactacatgctctgtctcttttcccttttacctccctccagcgattcaaaatcaacaacgatttttacacccgaatgacccttcaggacaaagacagcaacaaatgatctcgtttgatcctcaacaacaggtgcaaccatatgttgcacaacagcagcaacaacaacaacatctattgcagtactggagagacattctgaagctgagtccgagcggaagaatgatgatgatgaacatgttaagacaagaaagcgatctgccactgacgaggccaccggttcaacccttcagcgccaccaagctatatagaggtgtcaggcaacgccactggggaaaatgggttgccgagatccgtaagccacgaaacaggacacgtctctggctagggacattcgatacagcagaagaagccgccatggcctacgaccgcgaggccttcaagttgaggggagagaccgctaggctcaatttccctgaactttttctcaataaacaagagccaactcccgtgcatcagaaacaatgtgagacggggactactagtgaagactcaagcagaagaggagaggatgattcgagcacggcattggcagtaggaggggtgagtgaggagacgggttgggctgaggcatggttcaatgcaattccagaggaatggggacctggaagccctctatgggatgattaccactttcccatttctaaccataaggacgatcttgacgccacacaaaactcttcttctgatacaatttaggacctttgttagaatatagatatgcttagttgtatgactgatctagcttgtgttttttttttgggtggagacagtttttgtcatcttccacattttagattctattttcgaccatcatttttttcttgatcggtgactatgaatctaatggggtcaatcattttcacatataaaactta

SEQ ID NO: 1749 - protein, 336 aa, Arabidopsis thaliana
  G1385 Amino Acid Sequence
MATAKNKGKSIRVLGTSEAEKKDEMELEEEFQFSSGKYKDSGPGSDMWLGDASSTSPRSLRKTRTFDRHNPYLVSSYATPQPPTTTTCSVSFPFYLPPAIQNQQRFLHPNDPSGQRQQQMISFDPQQQVQPYVAQQQQQQQHLLQYWRDILKLSPSGRMMMMNMLRQESDLPLTRPPVQPFSATKLYRGVRQRHWGKWVAEIRKPRNRTRLWLGTFDTAEEAAMAYDREAFKLRGETARLNFPELFLNKQEPTPVHQKQCETGTTSEDSSRRGEDDSSTALAVGGVSEETGWAEAWFNAIPEEWGPGSPLWDDYHFPISNHKDDLDATQNSSSDTI

SEQ ID NO: 1750 - DNA, 1011 bp, Arabidopsis thaliana
  G1385 Genomic Sequence
atggctactgctaagaacaagggaaaatcaatcagggtccttggtaccagtgaagcagagaaaaaggatgagatggagttggaggaggagttccagtttagtagcggcaagtataaagattcgggtcctggctcggacatgtggttaggagatgcttcctctacgtctccaagaagtcttaggaagactagaacctttgaccgacataatccctatctcgtatcttcttatgctactcctcagccgccaacaacaactacatgctctgtctcttttcccttttacctccctccagcgattcaaaatcaacaacgatttttacacccgaatgacccttcaggacaaagacagcaacaaatgatctcgtttgatcctcaacaacaggtgcaaccatatgttgcacaacagcagcaacaacaacaacatctattgcagtactggagagacattctgaagctgagtccgagcggaagaatgatgatgatgaacatgttaagacaagaaagcgatctgccactgacgaggccaccggttcaacccttcagcgccaccaagctatatagaggtgtcaggcaacgccactggggaaaatgggttgccgagatccgtaagccacgaaacaggacacgtctctggctagggacattcgatacagcagaagaagccgccatggcctacgaccgcgaggccttcaagttgaggggagagaccgctaggctcaatttccctgaactttttctcaataaacaagagccaactcccgtgcatcagaaacaatgtgagacggggactactagtgaagactcaagcagaagaggagaggatgattcgagcacggcattggcagtaggaggggtgagtgaggagacgggttgggctgaggcatggttcaatgcaattccagaggaatggggacctggaagccctctatgggatgattaccactttcccatttctaaccataaggacgatcttgacgccacacaaaactcttcttctgatacaatttag

SEQ ID NO: 1751 - DNA, 1011 bp, Arabidopsis thaliana
  G1385 DNA sequence used for BLAST
ctaaattgtatcagaagaagagttttgtgtggcgtcaagatcgtccttatggttagaaatgggaaagtggtaatcatcccatagagggcttccaggtccccattcctctggaattgcattgaaccatgcctcagcccaacccgtctcctcactcacccctcctactgccaatgccgtgctcgaatcatcctctcctcttctgcttgagtcttcactagtagtccccgtctcacattgtttctgatgcacgggagttggctcttgtttattgagaaaaagttcagggaaattgagcctagcggtctctcccctcaacttgaaggcctcgcggtcgtaggccatggcggcttcttctgctgtatcgaatgtccctagccagagacgtgtcctgtttcgtggcttacggatctcggcaacccattttccccagtggcgttgcctgacacctctatatagcttggtggcgctgaagggttgaaccggtggcctcgtcagtggcagatcgctttcttgtcttaacatgttcatcatcatcattcttccgctcggactcagcttcagaatgtctctccagtactgcaatagatgttgttgttgttgctgctgttgtgcaacatatggttgcacctgttgttgaggatcaaacgagatcatttgttgctgtctttgtcctgaagggtcattcgggtgtaaaaatcgttgttgattttgaatcgctggagggaggtaaaagggaaaagagacagagcatgtagttgttgttggcggctgaggagtagcataagaagatacgagatagggattatgtcggtcaaaggttctagtcttcctaagacttcttggagacgtagaggaagcatctcctaaccacatgtccgagccaggacccgaatctttatacttgccgctactaaactggaactcctcctccaactccatctcatcctttttctctgcttcactggtaccaaggaccctgattgattttcccttgttcttagcagtagccat

SEQ ID NO: 1752 - DNA, 1317 bp, Arabidopsis thaliana
  G1389 cDNA Sequence
atgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaagacaaccatggaggttcaaattcatgatgacatgcattgaacaagaaggaggaaattaatgtgatgaatggagctagagtaagcgctatattaattagtattaccatctatccatatatttatgattcaagactattattactcatttagtgtttgttattattattcaattttgcttgtttgtttcttatcatctttgcattgatcatcaagattgtgatatttg

SEQ ID NO: 1753 - protein, 361 aa, Arabidopsis thaliana
  G1389 Amino Acid Sequence
MGLKGYSVGEGGGEIVEVQGGHIIRATGRKDRHSKVFTSKGPRDRRVRLSAHTAIQFYDVQDRLGYDRPSKAVDWLIKKAKTAIDKLELGETTTTTTRQEPVNTKPESPTLVFQRENNDQTQFVAANLDPEDAMKTFFPATTTTNGGGGTNINFQNYPHQDDNNMVSRTTTPPPNLSQDLGLSLHPFQGNNNTVVVPETNNFTTTHFDTFGRISGWNHHDLTMTSSSSSEHQQQEQEERSNGGFMVNHHPHHHHHQPSMMTLLNSQQQQVFLGGQQQQQQRGTLQSSLFPHSFRSWDHHQTTSDHHHHQNQASSMFASSSQYGSHGMMMMQGLSFPNTTRLLHGEEATQPNSSSSPPNSHL

SEQ ID NO: 1754 - DNA, 1086 bp, Arabidopsis thaliana
  G1389 Genomic Sequence
atgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaa

SEQ ID NO: 1755 - DNA, 1086 bp, Arabidopsis thaliana; identical to SEQ ID NO: 1754
  G1389 DNA sequence used for BLAST

SEQ ID NO: 1756 - DNA, 1000 bp, Arabidopsis thaliana
  G1390 cDNA Sequence
gtttctttaaggtcttagggtttagtgaagctatagatttcaatttcatacatagttaacgtatagaaggaatcttgggttgatcaatggaaggttgtccaagaaacagagaaatcggtccaaaacttcttgatttgattccacaaggaaggaaatggtaccaagaagacaagaacaacacagatcaggagaagaaacttgagctaaggctgcaccgtggtgatgaagaagatcattcagcaatcaagaagaagaacacagagataagaaacatcaagaaggaaacagaagacaaatctttccactgttttaatggcaatcacttctctccttccaacaaaaccacttctgttcctcacatctcacagaaaagaactgctcctggtccagtggtgggttggcctccggttcgttcgttcagaaagaatctagcgagcacaagctcttcaaagctaggtaacgaatcctctcatggaggtcaaatcaacaagagtgatgatggtgaaaaacaagttgaaaccaagaaggaaggaatgtttgtcaagatcaacatggatggtgttcctattggtcgtaaagttgatctcaatgcttacaacagctacgaacagctctcttttgtcgttgacaaactcttcagaggtctactcgcagctcaaagagatatctctgatggtcaaggagaagagaaacctatcattggattattagatgggaaaggagaatttactttaacctatgaagacaatgaaggggacaagatgcttgttggggatgttccatggcaaatgtttgtttcatctgtgaagagactgcgtgtgattaaaagctctgagatttcatctgccttgacatttggatgcagtaagcaagagaagatgatgcactgaagagtctttttagaaacttttatttcagacagagagtctcaaagctttataaatgtacatctggtttttgttatatataagagttaatcattggtttaaaaaaaaaaaaa

SEQ ID NO: 1757 - protein, 267 aa, Arabidopsis thaliana
  G1390 Amino Acid Sequence
MEGCPRNREIGPKLLDLIPQGRKWYQEDKNNTDQEKKLELRLHRGDEEDHSAIKKKNTEIRNIKKETEDKSFHCFNGNHFSPSNKTTSVPHISQKRTAPGPVVGWPPVRSFRKNLASTSSSKLGNESSHGGQINKSDDGEKQVETKKEGMFVKINMDGVPIGRKVDLNAYNSYEQLSFVVDKLFRGLLAAQRDISDGQGEEKPIIGLLDGKGEFTLTYEDNEGDKMLVGDVPWQMFVSSVKRLRVIKSSEISSALTFGCSKQEKMMH

SEQ ID NO: 1758 - DNA, 1408 bp, Arabidopsis thaliana
  G1390 Genomic Sequence
tcagtgcatcatcttctcttgcttactgcatccaactgcaaatatacagaggaacccttttaatcatatagctctaataaatcatctaaacatataagaacagaagcttacatgtcaaggcagatgaaatctcagagcttttaatcacacgcagtctcttcacagatgaaacaaacattctgtgtttaaaaacaaagattaaagatcagttagtatgcaaaaaaagaggtataaacaaatctccaagcaaaattctattctttaggtaaagaattatcaatttgaattactactactattgattaaaagctgagaacttttgttgttatatgatcaagaatctaattctgcaaaacactgaatcagattcagagaacaaaaggggaaaagattcttactgccatggaacatccccaacaagcatcttgtccccttcattgtcttcataggttaaagtaaattctcctttcccatctaataatccaatgataggtttctcttctccttgaccatcagagatatctctttgagctataaaccaacaacatacacaaatcatactcagtaaacacaagtaacactcctaaagaactaaaaaacagaatttgagattaagatttaacctgcgagtagacctctgaagagtttgtcaacgacaaaagagagctgttcgtagctgttgtaagcattgagatcaactttacgaccaataggaacaccatccatgttgatcttgacaaacattccttccttcttggtttcaacttgtttttcaccatcatcactcttgttgatttgacctccatgagaggattcgttacctagctttgaagagcttgtgctcgctagattctttctgaacgaacgaaccggaggccaacccaccactggaccaggagcagttctttgaaccagatatcaaaagaaacaagagacatatgtcaataccaaacgacaaaaacagagcaaaacagagtaaatgttgaaacttttaacatgtgaaggtaaaaaaaaaaacacagattgcagaagatgggtccctaatgttcaagagaatatcctctgtcaaagcagtaagaaaaaataacagtgaaggaaaaaaaaggagattataccttttctgtgagatgtgaggaacagaagtggttttgttggaaggagagaagtgattgccattaaaacagtggaaagatttgtcttctgtttccttcttgatgtttcttatctctgtgttcttcttcttgattgctgaatgatcttcttcatcaccaccgggtggtccaagccttagctcaagtttcttctcctgatctgtgttgttcttgtcttcttggtaccatttccttccttgtggaatcaaatcaagaagttttggaccgatttctctgtttcttggacaaccttccat

SEQ ID NO: 1759 - DNA, 1408 bp, Arabidopsis thaliana; identical to SEQ ID NO: 1758
  G1390 DNA sequence used for BLAST

SEQ ID NO: 1760 - DNA, 462 bp, Arabidopsis thaliana
  G1394 cDNA Sequence
gtcctaagtatacatgtcttttttgtcttttgtctgaatctttctcgtcggaaacacagatctcagttccttacagaagaatctccgactcgtttctttgccggcattctcagatttccggatactagccatgagcagtgatggttccgccggaaaggcggttgttgaagccaaaggattgaaccctggattgatagtgctgcttgttattggaggtctgcttgtgacatttctcatagccaattacgttatgtacatgtatgctcagaagaatctacctccaaggaagaagaagcctctttccaaaaagaagctcaagcgtgagaagctgaagcagggagtccctgtgcccggcgaatagattccagcttcttcaacagtctgtgtttttaacctgtaatcacaatgtcattgagacttttgtatgggagagtagcaaacgtcccttgttctggaaaaaaa

SEQ ID NO: 1761 - protein, 76 aa, Arabidopsis thaliana
  G1394 Amino Acid Sequence
MSSDGSAGKAVVEAKGLNPGLIVLLVIGGLLVTFLIANYVMYMYAQKNLPPRKKKPLSKKKLKREKLKQGVPVPGE

SEQ ID NO: 1762 - DNA, 566 bp, Arabidopsis thaliana
  G1394 Genomic Sequence
ctattcgccgggcacagggactccctgcttcagcttctcacgcttgagcttctttttggaaagaggcttcttcttccttggaggtagattcttctgagcatacatgtacataacgtaattggctatgagaaatgtcacaagcagacctccaataacaagcagcactatcaatccagggttcaatcctttggcttcaacaaccgcctgtaaattcacaaacaatgtatgcaacaatccataccaaagtgagatatttgacatcatgtaaacctaacgaaactaatccatgaatacaattgaaattccctgtaaataaccagatcatgttcaaaataaacaatgcatgcgagaggatcatcaagatcaagacaacacaacaagcaacagattaaattgatgatcttcttctattcagctcataacagatctaacaataataaacagagatttggaacttaaaaaccaattatggatcagagaggagcgtgattggtaaacacagttcgatttcatcggaaattacaaatacggagacgtacctttccggcggaaccatcactgctcat

SEQ ID NO: 1763 - DNA, 566 bp, Arabidopsis thaliana; identical to SEQ ID NO: 1762
  G1394 DNA sequence used for BLAST

SEQ ID NO: 1764 - DNA, 435 bp, Arabidopsis thaliana
  G1395 cDNA Sequence
attttttccggcgagcggtgctgataacctcgtagctccgaaacgccgccatggccgcagaatttgatggaaaaatcgaaagcaaagggctaaacccgggactgatcgtccttcttgtaataggagggttgctactgacattccttgtaggaaacttcatcctttacacatacgcacagaagaatttacctccgaggaagaagaaacccgtttctaagaagaagatgaagaaagagaagatgaagcaaggcgtccaagttcctggcgagtagcttttgttatatgttgtcgggattatcctttgatgataactcactctgctggactagaacttgtatgactccgttactcattagttttttgatgttttcgatgtagcatgcatgatattttcttgagttgacaatctataagctttactgagataaaaaaaaa

SEQ ID NO: 1765 - protein, 73 aa, Arabidopsis thaliana
  G1395 Amino Acid Sequence
MAAEFDGKIESKGLNPGLIVLLVIGGLLLTFLVGNFILYTYAQKNLPPRKKKPVSKKKMKKEKMKQGVQVPGE

SEQ ID NO: 1766 - DNA, 1045 bp, Arabidopsis thaliana
  G1395 Genomic Sequence
ctactcgccaggaacttggacgccttgcttcatcttctctttcttcatcttcttcttagaaacgggtttcttcttcctcggaggtaaattcttctgtgcgtatgtgtaaaggatgaagtttcctacaaggaatgtcagtagcaaccctcctattacaagaaggacgatcagtcccgggtttagccctttgctttcgatttttccctgttcattgtgttcttattagtaacatatattgaaatctagatgcaagaagaaacaagaagatttgagaaatataatatatgaaacttgaaaggacagaacacaaggtatactaactagcttctcaatcttattggcccgtaagacagaacacaaggtatactaactaccaaagaccattactgcaagagtttggttaagtgacagattactgcagattaactaacactgacaagcacgaatatcatgaaacgaataccacaagttataatatccatagattgtacaatttgggaatgtataaaccatcatattcgttattcaccatgaaccttaaactctgaaacagccaaaaatgaaaaaacttgacattccatggcaagatcaagatgaaagtgatgaagttaaccaaagtcctcaaactcaaaatgtatgaaattctaaagaaaaaacaaaactttaccgatccaattgtgctaggtcctaacccatgctaaatttcagagaatttgatcatccatcgttaagaagcgttacaacaatcatacacgtattgaccaaaatgctcgaacataaacaaaaaaagctcgcaatcgcaaatcttaaaccggaacatcatgcatcaaaaccagaagatcagactcaagcaacacataagattacgagccacgcgtgaaagagtagcaaacgattgtaggaaagcagaattgagacagagtcaaacgcagatctagcgattcatcgtgagtaacgaaaaatttgatctcagacaaggaaacacaggtagacaaagagagatattcagagaggggacagaacttacatcaaattctgcggccat

SEQ ID NO: 1767 - DNA, 1035 bp, Arabidopsis thaliana
  G1395 DNA sequence used for BLAST
ctactcgccaggaacttggacgccttgcttcatcttctctttcttcatcttcttcttagaaacgggtttcttcttcctcggaggtaaattcttctgtgcgtatgtgtaaaggatgaagtttcctacaaggaatgtcagtagcaaccctcctattacaagaaggacgatcagtcccgggtttagccctttgctttcgatttttccctgttcattgtgttcttattagtaacatatattgaaatctagatgcaagaagaaacaagaagatttgagaaatataatatatgaaacttgaaaggacagaacacaaggtatactaactagcttctcaatcttattggcccgtaagacagaacacaaggtatactaactaccaaagaccattactgcaagagtttggttaagtgacagattactgcagattaactaacactgacaagcacgaatatcatgaaacgaataccacaagttataatatccatagattgtacaatttgggaatgtataaaccatcatattcgttattcaccatgaaccttaaactctgaaacagccaaaaatgaaaaaacttgacattccatggcaagatcaagatgaaagtgatgaagttaaccaaagtcctcaaactcaaaatgtatgaaattctaaagaaaaaacaaaactttaccgatccaattgtgctaggtcctaacccatgctaaatttcagagaatttgatcatccatcgttaagaagcgttacaacaatcatacacgtattgaccaaaatgctcgaacataaacaaaaaaagctcgcaatcgcaaatcttaaaccggaacatcatgcatcaaaaccagaagatcagactcaagcaacacataagattacgagccacgcgtgaaagagtagcaaacgattgtaggaaagcagaattgagacagagtcaaacgcagatctagcgattcatcgtgagtaacgaaaaatttgatctcagacaaggaaacacaggtagacaaagagagatattcagagaggggacagaacttacatcaaatt

SEQ ID NO: 1768 - DNA, 436 bp, Arabidopsis thaliana
  G1396 cDNA Sequence
tcgacctcgtttcctttcctcctctcttcctaccattagtacgttactggagctgatctcacgtatattttggatcgtaatcatggacggcgaagattttgccggaaaggcggctgctgaagccaagggattgaacccgggattaatcgtgctgcttgttgttggaggtccgcttcttgtgttcctaatcgccaactacgtgctttacgtttatgctcagaagaacctacctccaaggaagaagaagcccgtttccaaaaagaagctcaagcgggagaagctaaagcaaggagtccctgtccctggagaataaaagccagcttaagcttccttcacttgtgcctccttcaaagcggtttttgttcggttaccaaatttcacccttgcgggtttttttcttcctttacttctgtcatgaggattatctttgaggcct

SEQ ID NO: 1769 - protein, 76 aa, Arabidopsis thaliana
  G1396 Amino Acid Sequence
MDGEDFAGKAAAEAKGLNPGLIVLLVVGGPLLVFLIANYVLYVYAQKNLPPRKKKPVSKKKLKREKLKQGVPVPGE

SEQ ID NO: 1770 - DNA, 231 bp, Arabidopsis thaliana
  G1396 Genomic Sequence
atggacggcgaagattttgccggaaaggcggctgctgaagccaagggattgaacccgggattaatcgtgctgcttgttgttggaggtccgcttcttgtgttcctaatcgccaactacgtgctttacgtttatgctcagaagaacctacctccaaggaagaagaagcccgtttccaaaaagaagctcaagcgggagaagctaaagcaaggagtccctgtccctggagaataa

SEQ ID NO: 1771 - DNA, 579 bp, Arabidopsis thaliana
  G1396 DNA sequence used for BLAST
ttattctccagggacagggactccttgctttagcttctcccgcttgagcttctttttggaaacgggcttcttcttccttggaggtaggttcttctgagcataaacgtaaagcacgtagttggcgattaggaacacaagaagcggacctccaacaacaagcagcacgattaatcccgggttcaatcccttggcttcagcagccgcctatgaaattcagaccaatgtatgcataaatgataccaaacatagaaaacaacaatctaggaccaagcaaacatgtatactgaatgagattattgcaaagcgtgcaatgttgtccagcaatgcatgcaaatgattatttttttctattcctctaaaaagctaagacatcacataatttccttagatcattaacaaaatagcccacaaatcacgaatccaacccttaagaaatcgattgcacattccgggatcgcagaagaggagctattatggtaaaatcatctcgatttcaacggagataccgttaaattctacaaaaggtgaaagtatagagaagattgacggtacctttccggcaaaatcttcgccgtccat

SEQ ID NO: 1772 - DNA, 1011 bp, Arabidopsis thaliana
  G1398 cDNA Sequence
ggtcattgaatcattgatcgtgcatcaaagatactacaaaaagaagaaaatcaaatatataaagaaagaaggcgagtcattttatgacaacgagaaacagaacatcactaccaaacatctccagctcagtttcttcaaataaaaacattgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctaaagaagtagaggaagagaagaaagaaggatcagttaatcgagatgctgttctggctagagttgagacagagaagaggatgtcacttatcaaagcttgggaagaggctgagaaatgcaaagtggagaacaaagctgagaagaagctttcttcaattggatcatgggagaacaacaagaaagcagctgtggaagctgagctcaagaaaatggaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtatttgatgtaatgacgttctttagtttgcttaatgtgggtttaatatggcaacatagaaagttataaggtcaacatcttatattgattgggctgcgtttgttaatttgatttgtatttgtacatcttttcattgaaaggctttctcttagctttatgaattggtaagtacaataatacatatttgttctttaaaaaaaa

SEQ ID NO: 1773 - protein, 229 aa, Arabidopsis thaliana
  G1398 Amino Acid Sequence
MTTRNRTSLPNISSSVSSNKNIVVPNIMAEEEPKKVTETVSEPTPTPEVPVEKPAAAADVAPQEKPVAPPPVLPSPAPAEEKQEDSKAIVPVVPKEVEEEKKEGSVNRDAVLARVETEKRMSLIKAWEEAEKCKVENKAEKKLSSIGSWENNKKAAVEAELKKMEEQLEKKKAEYVEQMKNKIAQIHKEAEEKRAMIEAKRGEEILKAEELAAKYRATGTAPKKLFGCM

SEQ ID NO: 1774 - DNA, 1621 bp, Arabidopsis thaliana
  G1398 Genomic Sequence
atgacaacgagaaacagaacatcactaccaaacatctccagctcagtttcttcaaataaaaacagttaatctctctaaaacaattttttgttttctctctctcttaaataaccagagagttcagaatcattttgattctctttgtaatctttagttgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctagtaatttgcttactatcttgtttttcaacagaaagattattactaactcaagtttggttcaatgattattaaaaacttctgccaaaatatgtttctattaatcaactgattagcgtcgtcaaatatacctgattttcttaaagattattactgattacatttccgattaaaaacagaattttataccttttctttaatatagaaaaataaacaagtttcaaaattctgtaattatgtaagttttaaggttaaaaaagaagaactcaaagatttttgttcttctctaatgtgttgttattaatttttctttattaatacttaataaaaaatttattttgtggcagaagaagtagaggaagagaagaaagaaggatcagttaatcgaggtaattaacgtaatagattcatgactaatactaatattatctgaaagtaaaggatcatgggtgtaatataaataattagtatttttgtcataccggggaacaattaattaggtggtttgtgtgtcgtgttatcatgggatgtgtctaaaactgaaagatggtttaataatattcactaattttgggtgaaggttgttatatggacatgtgtgtttatcattgtctcttatttttcccacaaactctgattagtgattgtatttgcttaataattttgggagtgaagatgctgttctggctagagttgagacagagaagaggatgtcacttatcaaagcttgggaagaggctgagaaatgcaaagtggagaacaagtaacgtttttcatgttaacatttatccataaatgtctattaacccgatttagtaatattttgcaatgaaaccaagatattatcattaaggtcttgaagaatatattttgaaacagagctgagaagaagctttcttcaattggatcatgggagaacaacaagaaagcagctgtggaagctgagctcaagaaaatggaggtatgtttgaagttaatatttagttagagattttgaagcatttctgatttagctccgagctttttcaaaattgtggaatttttttttaacaacaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtga

SEQ ID NO: 1775 - DNA, 1621 bp, Arabidopsis thaliana; identical to SEQ ID NO: 1774
  G1398 DNA sequence used for BLAST

SEQ ID NO: 1776 - DNA, 249 bp, Arabidopsis thaliana
  G1403 cDNA Sequence
atgtgttgttactttgccactaggattgtttacggcctgcaaccggaggctctgatgatgttggatgcattgggtgatgaattatacaaggacagtaccctgattatgaagattcttagagacaatctcactttctggacttcagatatgactgacgaagcaggagatgagatcaaggaggcagaaccaaaggtcttgtgcaaatgtcattcttgtttcactgtcttgtcggaaccaaagcatagttaa

SEQ ID NO: 1777 - protein, 82 aa, Arabidopsis thaliana
  G1403 Amino Acid Sequence
MCCYFATRIVYGLQPEALMMLDALGDELYKDSTLIMKILRDNLTFWTSDMTDEAGDEIKEAEPKVLCKCHSCFTVLSEPKHS

SEQ ID NO: 1778 - DNA, 682 bp, Arabidopsis thaliana
  G1403 Genomic Sequence
ttcacactgaagttataaggacttggggtacaagagtcgttggtttgactctccttgtgattggtgctatgagaatcaaagaagcttctgagatcccataaccatgtgttgttactttgccactaggattgtttacggcctgcaaccggaggctctgatgatggtacatattttgtcacctgaagacgttactagtaattatgttctttgtgctgcttttattcattaattgcttaaactaaatgttgtcgttgcaagatctttgttcttgtatgttggacaatgccaatgtgctatcgctgagttggatgcattgggtgatgaattatacaaggacagtaccctgattatgaagattcttagagacaatctcactttctggacttcagatatgactgtaagcatcaacacaatatacattgatcattgttcactaagttctgtaattgacatgattataactctttggtcaataggacgaagcaggagatgagatcaaggaggcagaaccaaaggtcttgtgcaaatgtcattcttgtttcactgtcttgtcggaaccaaagcatagttaaaattcatattctagtactctcttgattaataataattggaaatgtattatagcgagtaaaagtaaacatgtgcaaccaagagttgtttctttttgtgaatatgttttgta

SEQ ID NO: 1779 - DNA, 469 bp, Arabidopsis thaliana
  G1403 DNA sequence used for BLAST
atgtgttgttactttgccactaggattgtttacggcctgcaaccggaggctctgatgatggtacatattttgtcacctgaagacgttactagtaattatgttctttgtgctgcttttattcattaattgcttaaactaaatgttgtcgttgcaagatctttgttcttgtatgttggacaatgccaatgtgctatcgctgagttggatgcattgggtgatgaattatacaaggacagtaccctgattatgaagattcttagagacaatctcactttctggacttcagatatgactgtaagcatcaacacaatatacattgatcattgttcactaagttctgtaattgacatgattataactctttggtcaataggacgaagcaggagatgagatcaaggaggcagaaccaaaggtcttgtgcaaatgtcattcttgtttcactgtcttgtcggaaccaaagcatagttaa

SEQ ID NO: 1780 - DNA, 1034 bp, Arabidopsis thaliana
  G1411 cDNA Sequence
taaagaaaaactgaacaaccctaaagtactgtataaatcctatatcaaattttttttttggaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggttaaaaaaaaaaaaaaaaaaaaaaaaaaaaaa

SEQ ID NO: 1781 - protein, 248 aa, Arabidopsis thaliana
  G1411 Amino Acid Sequence
MYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 1782 - DNA, 1106 bp, Arabidopsis thaliana
  G1411 Genomic Sequence
atgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggtatatatatacatgctcatatcgatctttgaatcttttttggttgaaacaatgttaggatatattgaaattatgtgcaaatttcatatcagaagtaaatctcaaacttaaaaggttattattatactgtttatttcaatactcatttaccaaaagaaaaaacgattaggctattaccaaaatgtaatttttaacatggagattttgttggtagtatatggtttcagcaccaatattaggtgacgatatatatttatacacataaactatgagcatatacaaagtttacatactatgcacatgtatgagtagaccataccaaagattttctgatttcaacttttgtgatttcaataaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaa

SEQ ID NO: 1783 - DNA, 1106 bp, Arabidopsis thaliana
  G1411 DNA sequence used for BLAST
ttaatatcccgaatgaggagaggaagaagaatccccaaagcgccagaatctggcataatcttgctcttcttgttgcctagaagagccaccagaagacgaagaagttgtagcagcagtcgtagtactattatcatgagacattgaatatccggtaccactcccatacccaccgcccaaattaaaacttagcatatcaccactactcgcatcatgatagtattgattatagttcggtatactttgtggttccatttgtggaatttggttggaggagtaatatgtagagttacttccaagctgaaccctctccgggaaattgagttttgctttgcttcctttgaactttagggctgcttcatcataagctaaggccgcagattcagcggtttcaaatgtcccgagccacacacgtgccgccttttttgggtctcggatttcagctgcccactttccccatggcctttgccttacacctctataatgtctcctcctcaagtcccctttattgaaatcacaaaagttgaaatcagaaaatctttggtatggtctactcatacatgtgcatagtatgtaaactttgtatatgctcatagtttatgtgtataaatatatatcgtcacctaatattggtgctgaaaccatatactaccaacaaaatctccatgttaaaaattacattttggtaatagcctaatcgttttttcttttggtaaatgagtattgaaataaacagtataataataaccttttaagtttgagatttacttctgatatgaaatttgcacataatttcaatatatcctaacattgtttcaaccaaaaaagattcaaagatcgatatgagcatgtatatatataccttggtcttgatgagtaggcgcaacttgttgattagggtcttgtggattatacacagaaggatagttatcatcaatagagctgatgttatcatgagatttgctttgttggtttccgattacttgagtcaaggccgagaccataacacgcatgtcgtgttgagatcgggccgagaagaccgggaacaagttctcatcttcttccctttcttcagattcatcacctccaaaaggcctcttcccatacat

SEQ ID NO: 1784 - DNA, 1258 bp, Arabidopsis thaliana
  G1416 cDNA Sequence
attttttttcctctttactttacacaaaggaacaacaaataatgtggaaccttaacgactcacccgatcatcacgaagaatccgacagtagagggaatccggtcggacacgtgtcaaacgggatgagtcaatctgcaacgtggctaccgtttgtgcttccggtgaccaggaatttctttccggctcaaagcatggaaccgggagttcgttggtccggtttcaatagtgtcggtaagtcggatccaagcggatcgggtcgaccagaagagccggagatatcaccgccgataaagaagagccgacgtggtcctcgctcacgtagctctcagtatcgaggagttacgttttaccgacgaaccggaagatgggagtcacatatttgggactgtgggaagcaagtgtacttaggtggatttgacactgcacatgctgctgctcgagcctatgatcgagcggcgattaaattcagaggtgtagatgcagatattaatttcgacattgaagactaccttgacgatttgaaacagatgggaaatttgacaaaggaagagtttatgcatgtacttagaaggcaaagcactgggtttccaagaggcagttctaaatacagaggtgttactttgcacaaatgtggaagatgggagtcacgtttgggtcaattcctcaacaaaaagtacgtttatttgggtctctttgataccgagattgaagctgctagagcttatgataaagcggcaataaagtgtaatgggaaagacgctgttaccaattttgaccctaaagtatacgaggaagaagaagatcttagctcagagacgacgaggaacggtcataatcttggtctaagtctaggagaatcatcatctgaagagtttagactcaagtctgatattgcaagcataagaagtaggattagagatgaggagagattattagggagcgatctatcgctagcaatgatgacgacgactgtcagatcggaaaagcagcaatcggacggtggaggaaatcgagtggtgggaatggcagcatcatcaggattctctcctcaaccttccccttaccgcattcctcgcaccttccacttctctcgtccctgattcatcatcatcatcatcactatcatcacaatcatcatctgagctagtgttaaccaagttatgctttaatgaatttgagttattctcgagctatttttgggctctgtaatacatatatgttcttgagtacggtataacaagtttttttcttttggtaa

SEQ ID NO: 1785 - protein, 352 aa, Arabidopsis thaliana
  G1416 Amino Acid Sequence
MWNLNDSPDHHEESDSRGNPVGHVSNGMSQSATWLPFVLPVTRNFFPAQSMEPGVRWSGFNSVGKSDPSGSGRPEEPEISPPIKKSRRGPRSRSSQYRGVTFYRRTGRWESHIWDCGKQVYLGGFDTAHAAARAYDRAAIKFRGVDADINFDIEDYLDDLKQMGNLTKEEFMHVLRRQSTGFPRGSSKYRGVTLHKCGRWESRLGQFLNKKYVYLGLFDTEIEAARAYDKAAIKCNGKDAVTNFDPKVYEEEEDLSSETTRNGHNLGLSLGESSSEEFRLKSDIASIRSRIRDEERLLGSDLSLAMMTTTVRSEKQQSDGGGNRVVGMAASSGFSPQPSPYRIPRTFHFSRP

SEQ ID NO: 1786 - DNA, 1816 bp, Arabidopsis thaliana
  G1416 Genomic Sequence
atgtggaaccttaacgactcacccgatcatcacgaagaatccgacagtagagggaatccggtcggacacgtgtcaaacgggatgagtcaatctgcaacgtggctaccgtttgtgcttccggtgaccaggaatttctttccggctcaaagcatggaaccgggagttcgttggtccggtttcaatagtgtcggtaagtcggatccaagcggatcgggtcgaccagaagagccggagatatcaccgccgataaagaagagccgacgtggtcctcgctcacgtagctctcagtatcgaggagttacgttttaccgacgaaccggaagatgggagtcacatatttggtaaatcacataataccttttaaaaccatatgtagtgttatcatttcaattattttcataaaatgttttggaatattatgcagggactgtgggaagcaagtgtacttaggtatggttcatatacataaaaattacgatttaacttttgtgtcttcgatttatttgacaaaacaaagggttttgtttccttctaattgttgttacatatatatgcaggtggatttgacactgcacatgctgctgctcggtatattttcgaacctagctaacgcattactatactagtatcattttttgttcattattttgttattggctataatatgggtcaataaatatttgagacagagcctatgatcgagcggcgattaaattcagaggtgtagatgcagatattaatttcgacattgaagactaccttgacgatttgaaacaggttctatataagtcttttatggatatatctactttaggttatactagtaatttaattacttactactcagaagaaaacacaatgaaatattggttttttttttttgcagatgggaaatttgacaaaggaagagtttatgcatgtacttagaaggcaaagcactgggtttccaagaggcagttctaaatacagaggtgttactttgcacaaatgtggaagatgggagtcacgtttgggtcaattcctcaacaaaaagtattaatttcttcatagtttttggtgcaaatattaaatttccagtctgtttcttattaatttgaagtgtcctgtttgctttttttgtttgctatcttttcaggtacgtttatttgggtctctttgataccgagattgaagctgctaggtacttcttcattattcactgtctcatcaccaaaaaaaatatttacttttttcctggtacgaaatatgaaaaaactgaaatttgaatatagagcttatgataaagcggcaataaagtgtaatgggaaagacgctgttaccaattttgaccctaaagtatacgaggaagaagaagatcttagctcaggtaaatttatttttactttttttttttgtcttaaaatttactccagtcaccagattctattgtaaaaatcaacagagacgacgaggaacggtcataatcttggtctaagtctaggagaatcatcatctgaagagtttagactcaagtctgatgtaagtgttcatgtttgtgtatgtatattgtttttgtcggaaaataattaaattggtgatataattcatatgtatgataattttaaagattgcaagcataagaagtaggattagagatgaggagagattattagggagcgatctatcgctagcaatgatgacgacgactgtcagatcggaaaagcagcaatcggacggtggaggaaatcgagtggtgggaatggcagcatcatcaggattctctcctcaaccttccccttaccgcattcctcgcaccttccacttctctcgtccctga

SEQ ID NO: 1787 - DNA, 1816 bp, Arabidopsis thaliana
  G1416 DNA sequence used for BLAST
tcagggacgagagaagtggaaggtgcgaggaatgcggtaaggggaaggttgaggagagaatcctgatgatgctgccattcccaccactcgatttcctccaccgtccgattgctgcttttccgatctgacagtcgtcgtcatcattgctagcgatagatcgctccctaataatctctcctcatctctaatcctacttcttatgcttgcaatctttaaaattatcatacatatgaattatatcaccaatttaattattttccgacaaaaacaatatacatacacaaacatgaacacttacatcagacttgagtctaaactcttcagatgatgattctcctagacttagaccaagattatgaccgttcctcgtcgtctctgttgatttttacaatagaatctggtgactggagtaaattttaagacaaaaaaaaaaagtaaaaataaatttacctgagctaagatcttcttcttcctcgtatactttagggtcaaaattggtaacagcgtctttcccattacactttattgccgctttatcataagctctatattcaaatttcagttttttcatatttcgtaccaggaaaaaagtaaatattttttttggtgatgagacagtgaataatgaagaagtacctagcagcttcaatctcggtatcaaagagacccaaataaacgtacctgaaaagatagcaaacaaaaaaagcaaacaggacacttcaaattaataagaaacagactggaaatttaatatttgcaccaaaaactatgaagaaattaatactttttgttgaggaattgacccaaacgtgactcccatcttccacatttgtgcaaagtaacacctctgtatttagaactgcctcttggaaacccagtgctttgccttctaagtacatgcataaactcttcctttgtcaaatttcccatctgcaaaaaaaaaaaaccaatatttcattgtgttttcttctgagtagtaagtaattaaattactagtataacctaaagtagatatatccataaaagacttatatagaacctgtttcaaatcgtcaaggtagtcttcaatgtcgaaattaatatctgcatctacacctctgaatttaatcgccgctcgatcataggctctgtctcaaatatttattgacccatattatagccaataacaaaataatgaacaaaaaatgatactagtatagtaatgcgttagctaggttcgaaaatataccgagcagcagcatgtgcagtgtcaaatccacctgcatatatatgtaacaacaattagaaggaaacaaaaccctttgttttgtcaaataaatcgaagacacaaaagttaaatcgtaatttttatgtatatgaaccatacctaagtacacttgcttcccacagtccctgcataatattccaaaacattttatgaaaataattgaaatgataacactacatatggttttaaaaggtattatgtgatttaccaaatatgtgactcccatcttccggttcgtcggtaaaacgtaactcctcgatactgagagctacgtgagcgaggaccacgtcggctcttctttatcggcggtgatatctccggctcttctggtcgacccgatccgcttggatccgacttaccgacactattgaaaccggaccaacgaactcccggttccatgctttgagccggaaagaaattcctggtcaccggaagcacaaacggtagccacgttgcagattgactcatcccgtttgacacgtgtccgaccggattccctctactgtcggattcttcgtgatgatcgggtgagtcgttaaggttccacat

SEQ ID NO: 1788 - DNA, 820 bp, Arabidopsis thaliana
  G1419 cDNA Sequence
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 1789 - protein, 221 aa, Arabidopsis thaliana
  G1419 Amino Acid Sequence
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 1790 - DNA, 666 bp, Arabidopsis thaliana
  G1419 Genomic Sequence
atggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaa

SEQ ID NO: 1791 - DNA, 666 bp, Arabidopsis thaliana
  G1419 DNA sequence used for BLAST
ttaagtaactacgagttgagagtgtccaagagatggacaaggagataacagaggcacggaaaatattcccatgtctttactgtctgctccgtcccaaaaccccttccaacttgatggcgttaatggacaagcatcagcctgaacctgagcttcttccctcttaacagctttacggctgatcagctggctttcatcctccgtcacctgtctcttcctctttgcttttaaagaaatagtcttcttgttgtctcccaagtcctcatgctttcctgcttcaagtgggaagttaagaatagctttgcttcctcgtagtttaaaagctgccttgtcataacctcttgcagcttccatggctgtgtcaaaagtgcctaaccagacacgaacacctttcttgtttgggtctctgatctcagccgcatacttaccccatggtcttctcctgacgcctctgtaatgcctttgatcattctcttgaaccaccggtgcagtagtaggaactgctatagtggcaagaggtggtttgcgttggcttagagttgaggtggtgcagtggtggatggtggaggcaaaggtgtctaaggaagggaaatcagtaagaaggtgttgggttatgagatctaaagctgactggtcttgttcttgctgttgttgatgtgaagaagccat

SEQ ID NO: 1792 - DNA, 1242 bp, Arabidopsis thaliana
  G1427 cDNA Sequence
tttcctcttaaccatccactaatcaaacactaaaacctagaaaaaaaaaggatcaaatcatggagacggaagaagagatgaaggaaagtagtataagcatggtggaggcaaagttgcctccgggattcagatttcacccgaaggacgatgagcaagtctgcgattacttgatgagacgatcgcttcacaataatcatcgaccacctcttgtcctgatccaagtcgatctcaacaagtgtgagccttgggacatcccaaaaatggcatgcgtgggagggaaggattggtatttctacagccaaagagaccgaaaatacgcgacggggctgagaactaaccgagcaacggccaccggatattggaaagccaccggcaaagacagaaccattctaagaaagggtaagctagttgggatgaggaagacattggttttctatcaaggtcgagctcctcgaggccgtaaaaccgattgggtcatgcacgaattccgtctccaaggatctcatcatcctcccaatcattctctgagctctccaaaggaagactgggtcttgtgtagggtattccataagaatacggaaggagttatatgtagagacaacatgggaagctgttttgatgagacagcctctgcatcgcttcctccactgatggatccttacatcaactttgaccaagaaccctcttcttatctcagtgatgatcatcactacatcatcaatgagcacgtaccctgcttctccaatttgtcacagaaccaaaccttaaactcgaacctaaccaactcagtctctgaactcaagattccatgcaagaaccctaaccccttgtttactggtggttcagcctcagccacgctcacaggcctcgactcattctgttcttcagatcagatggttctcagagctctactcagtcagctcactaagattgatggaagcctcgggcctaaagaatcacagagttatggagaaggtagctcggagagcctcctgaccgacatcggtattccaagcactgtttggaattgctgatgatcgagtgtaacgagagttactattgctatattcctatccatgattggaacaattcttcggggggaaataacgtgtgcttgtctgattgtacaaacatttcctcactcttgtacccacggtagattcatgtaaaataccacttatgacgctagacatacatatatttcatcgtagttccatttaaaaaaaaaaaaaaaaaaaaaaa

SEQ ID NO: 1793 - protein, 324 aa, Arabidopsis thaliana
  G1427 Amino Acid Sequence
METEEEMKESSISMVEAKLPPGFRFHPKDDEQVCDYLMRRSLHNNHRPPLVLIQVDLNKCEPWDIPKMACVGGKDWYFYSQRDRKYATGLRTNRATATGYWKATGKDRTILRKGKLVGMRKTLVFYQGRAPRGRKTDWVMHEFRLQGSHHPPNHSLSSPKEDWVLCRVFHKNTEGVICRDNMGSCFDETASASLPPLMDPYINFDQEPSSYLSDDHHYIINEHVPCFSNLSQNQTLNSNLTNSVSELKIPCKNPNPLFTGGSASATLTGLDSFCSSDQMVLRALLSQLTKIDGSLGPKESQSYGEGSSESLLTDIGIPSTVWNC

SEQ ID NO: 1794 - DNA, 2293 bp, Arabidopsis thaliana
  G1427 DNA sequence used for BLAST
tcagcaattccaaacagtgcttggaataccgatgtcggtcaggaggctctccgagctaccttctccataactctgtgattctttaggcccgaggcttccatcaatcttagtgagctgactgagtagagctctgagaaccatctgatctgaagaacagaatgagtcgaggcctgtgagcgtggctgaggctgaaccaccagtaaacaaggggttagggttcttgcatggaatcttgagttcagagactgagttggttaggttcgagtttaaggtttggttctgtgacaaattggagaagcagggtacgtgctcattgatgatgtagtgatgatcatcactgagataagaagagggttcttggtcaaagttgatgtaaggatccatcagtggaggaagcgatgcagaggctgtctcatcaaaacagcttcccatgttgtctctacatataactccttccgtattcttatggaataccctacacaagacccagtcttcctgattccctcaacaacacataaacacgtatattactcgttacagatttgctaagaagagattaactgacgatcaataactggattatttaactgtgtatacctttggagagctcagagaatgattgggaggatgatgagatccttggagacggaattcgtgcatgacccaatcggttttacggcctcgaggagctcgaccttgatagaaaaccaatgtcttcctcatcccaactagcttaccctttcttagaatggttctgtctttgccggtggctttccaatatccggtggccgttgctcggttagttctcagccccgtcgcgtattttcggtctctttggctgtagaaataccaatccttccctcccacgcatgccatttctaatcatttgtttgaaacatacacacaaacacgcttagttgtattatacactacaggataatgaaactgatcatgtgattaaatgttagcgccaacttttttgtctcgcaatagtataaattttgtccttttgtttagaaacatttagcttttaaaacttaacttggttaatcaacaaaaaaattgtaggatattattgaaaataaatagaaaagtttaatgaatctcataacgagaatttttttctttataagatatgccatgttcaaatatatcggctattttaggatttacgattaatagtatagataaaagatacatccgtgagggattgaactaaagcatgtcaacatgtgattattcaaccaaaacaacgaataggaatccaacgcgtgtaaatgagtaggattttgattttttttttttttttgtggaattttgtttgaaataaagaaaaatatctttgatcaaatgaatgacgactaagcattgaataattattatgtagttgaagggtcaatttaacattgatttgaaaactaatcaggacccattagaggcgtaagcaaaggagagaataagaatactaattttgatcaaacccaacgaattttacattttgaaacttaaaatatgtcacactctaaaggctataaaccaacaaaatcgagatattgactttttcgtcgttactcttattttattttatccaaagcttttttttcaagaatttggttgaggataacgccaagagtgtcaacttctcgtatacaattatctatgcctctcgaattaatttcatattattacgtaatatatgtaaatttcttataaattgtaatcatctgatcatgaaaataaaagacttataaagtatgtatatatgtgtattaattttaccccaatccataacattatataaatcgactagtattgttatatgtttgaataaggtttttgtgataaatagactacattgtataaactggatgcaaaataaatgaggtgacatcatcatcttaaagtttattggttccaacttttgttttagtagatatggattaattaactaacttctaaagttttgtttctagaaaaccatgaacacgaaagaagatcatgacataatcttctatatggaccaaccatatcaaagtaaaacagagatatatggatcaataaagatactgttgtcaagaatgaatgaaaacgtacttgggatgtcccaaggctcacacttgttgagatcgacttggatcaggacaagaggtggtcgatgattattgtgaagcgatcgtctcatcaagtaatcgcagacaagctcatcgtccttcgggtgaaatctgaatcccggaggcaactttgcctccaccatgcttatactactttccttcatctcttcttccgtctccat

SEQ ID NO: 1795 - DNA, 1281 bp, Arabidopsis thaliana; identical to SEQ ID NO: 99
  G1435 cDNA Sequence

SEQ ID NO: 1796 - protein, 298 aa, Arabidopsis thaliana
  G1435 Amino Acid Sequence
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 1797 - DNA, 897 bp, Arabidopsis thaliana
  G1435 Genomic Sequence
atggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaa

SEQ ID NO: 1798 - DNA, 897 bp, Arabidopsis thaliana; identical to SEQ ID NO: 1797
  G1435 DNA sequence used for BLAST

SEQ ID NO: 1799 - DNA, 1488 bp, Arabidopsis thaliana
  G1437 cDNA Sequence
ggccgcccgggcaggtcaaatctctctccctctctctctatatatgttacattagtatgatatgaaagtaaaggcaagcaacgttttactcattatcttctcaccaaatttatagcccacaacggatcttttactttctttcttttgaaataagtcacatgttcttcagtctcttctcatgataatataaagggcaaaagaaaaatctcacaatctttacaagagtttttaaaatctctaaccttcatggactttctcaaagtttcagacaagacaacaattccatatagaagtgattctttgtttagtttgaatcagcaacaatacaaagagtcttcttttggattcagagacatggagattcatccgcatcctactccatatgcaggaaatggacttttgggttgttattactattaccctttcacaaacgcacaattgaaggagcttgagagacaagcaatgatctacaagtacatgatcgcatctattcctgttcctttcgatctacttgtttcttcaccatcctctgcctctccttgtaacaataaaaacatcgccggagatttagagccgggaagatgccggagaacagacggaaagaaatggagatgcgcgaaagaagtcgtctctaatcacaaatactgtgagaaacacttacacagaggtcgtcctcgttcaagaaagcatgtggaacctccttattctcgccctaacaacaatggtggttctgtgaaaaacagagatctcaaaaagcttcctcaaaagttatctagtagttccatcaaagacaaaacacttgagccaatggaggtttcatcatcaatctcaaactatagagactccagaggaagtgagaaatttactgtattggcaacaacagagcaagagaacaagtatctgaatttcatagatgtatggtccgatggagtaagatcatctgaaaaacagagtacaacttcaacacctgtttcttcttccaatggcaatctctctctttactcgcttgatctctcaatgggaggaaacaacttaatgggccaagacgaaatgggcctgatacaaatgggcttaggtgtaatcgggtcgggtagtgaggatcatcacgggtatggtccttatggtgtgacttcttcactagaggagatgtcaagctggcttgctccgatgtctaccacacctggtggaccattagcggagatactgaggccgagtacgaatttggcgatctctggtgatatcgaatcgtatagcttgatggagactcccactccaagctcgtccccgtctagagtgatgaagaagatgactagttcagtgtccgacgaaagcagccaggtttaggagttatggagtttggtaataacgactttttgtttgagttttggcctttcttcaatcttgtgcctgtaaactagtactgtaaacagtcactttgattaattatggagttatattatcaatgcttgattagtttttaaaaaaaaa

SEQ ID NO: 1800 - protein, 365 aa, Arabidopsis thaliana
  G1437 Amino Acid Sequence
MDFLKVSDKTTIPYRSDSLFSLNQQQYKESSFGFRDMEIHPHPTPYAGNGLLGCYYYYPFTNAQLKELERQAMIYKYMIASIPVPFDLLVSSPSSASPCNNKNIAGDLEPGRCRRTDGKKWRCAKEVVSNHKYCEKHLHRGRPRSRKHVEPPYSRPNNNGGSVKNRDLKKLPQKLSSSSIKDKTLEPMEVSSSISNYRDSRGSEKFTVLATTEQENKYLNFIDVWSDGVRSSEKQSTTSTPVSSSNGNLSLYSLDLSMGGNNLMGQDEMGLIQMGLGVIGSGSEDHHGYGPYGVTSSLEEMSSWLAPMSTTPGGPLAEILRPSTNLAISGDIESYSLMETPTPSSSPSRVMKKMTSSVSDESSQV

SEQ ID NO: 1801 - DNA, 1294 bp, Arabidopsis thaliana
  G1437 DNA sequence used for BLAST
atggactttctcaaagtttcagacaagacaacaattccatatagaagtgattctttgtttagtttgaatcagcaacaatacaaagagtcttcttttggattcagagacatggagattcatccgcatcctactccatgtaacaatctctctctctgttcttctcttcttttgatttgtttctcaataacgaaatgttattctcattgatttgtaacagatgcaggaaatggacttttgggttgttattactattaccctttcacaaacgcacaattgaaggagcttgagagacaagcaatgatctacaagtacatgatcgcatctattcctgttcctttcgatctacttgtttcttcaccatcctctgcctctccttgtaacaataaaaacatcgccggagatttagagccgggaagatgccggagaacagacggaaagaaatggagatgcgcgaaagaagtcgtctctaatcacaaatactgtgagaaacacttacacagaggtcgtcctcgttcaagaaagcatgtggaacctccttattctcgccctaacaacaatggtggttctgtgaaaaacagagatctcaaaaagcttcctcaaaagttatctagtagttccatcaaagacaaaacacttgagccaatggaggtttcatcatcaatctcaaactatagagactccaggtactgttctttgattagtctcaaaaccaaactctgtttttcttttctcataacaatactctgtttttggtctctgttttaatcgtgtttagtttttgtttcaacttgaaaacagaggaagtgagaaatttactgtattggcaacaacagagcaagagaacaagtatctgaatttcatagatgtatggtccgatggagtaagatcatctgaaaaacagagtacaacttcaacacctgtttcttcttccaatggcaatctctctctttactcgcttgatctctcaatgggaggaaacaacttaatgggccaagacgaaatgggcctgatacaaatgggcttaggtgtaatcgggtcgggtagtgaggatcatcacgggtatggtccttatggtgtgacttcttcactagaggagatgtcaagctggcttgctccgatgtctaccacacctggtggaccattagcggagatactgaggccgagtacgaatttggcgatctctggtgatatcgaatcgtatagcttgatggagactcccactccaagctcgtccccgtctagagtgatgaagaagatgactagttcagtgtccgacgaaagcagccaggtttag

SEQ ID NO: 1802 - DNA, 1586 bp, Arabidopsis thaliana
  G1438 cDNA Sequence
agagagagagagagagagagagagagagagagagagagagatatcaaaccagaggaaaagagtgacagagaaagtggtcatctttgtctgtctctgtccgaaactcaggagccctaatctctgaatccatcaagaaagctctttctcttccttcttttatgcttctgaatttgctacatatataaactatctgaagaaagctagagaataaagatgatgagtctaagtggaagtagcgggagaacaataggaaggcctccatttacaccaacacaatgggaagaactggaacatcaagccctaatctacaagtacatggtctctggtgttcctgtcccacctgagctcatcttctccattagaagaagcttggacacttccttggtctctagactccttcctcaccaatcccttggatgggggtgttaccagatgggatttgggagaaaaccagatccagagccaggaagatgcagaagaacagatggtaagaaatggagatgctcaagagaagcttacccagattcgaagtactgtgaaaaacacatgcacagaggaagaaaccgtgccagaaaatctcttgatcagaatcagacaacaacaactcctttaacatcaccatctctctcattcaccaacaacaacaacccaagtcccaccttgtcttcttcttcttcctctaattcctcttctactacttattctgcttcttcttcttcaatggatgcctacagtaacagtaataggtttgggcttggtggaagtagtagtaacactagaggttatttcaacagccattctcttgattatccttatccttctacttcacccaaacaacaacaacaaactcttcatcatgcttccgctttgtcacttcatcaaaatactaattctacttctcagttcaatgtcttagcctctgctactgaccacaaagacttcaggtactttcaagggattgggagagagttggaggagttgggagaagaacgttctttccagaagcatctagaagctttcaagattctccataccatcatcaccaacaacccgttagcaacagtgatgaatgatccgtaccaccactgtagtactgatcataataagattgatcatcatcacacatactcatcctcatcatcatctcaacatcttcatcatgatcatgatcatagacagcaacagtgttttgttttgggcgccgacatgttcaacaaacctacaagaagtgtccttgcaaactcatcaagacaagatcaaaatcaagaagaagatgagaaagattcatcagagtcgtccaagaagtctctacatcacttctttggtgaggactgggcacagaacaagaacagttcagattcttggcttgacctttcttcccactcaagactcgacactggtagctaattaagtagagctggcatcaatgatggatctgcaccaacacacacaactgtgaaatggtgaagaagagtcacatttcacatctatttccgtggaacaatgagacaagacactgtttgcagaatcctatatggattttttctatctttttctatgggggggtaggccaacaagaaaaagtg

SEQ ID NO: 1803 - protein, 397 aa, Arabidopsis thaliana
  G1438 Amino Acid Sequence
MMSLSGSSGRTIGRPPFTPTQWEELEHQALIYKYMVSGVPVPPELIFSIRRSLDTSLVSRLLPHQSLGWGCYQMGFGRKPDPEPGRCRRTDGKKWRCSREAYPDSKYCEKHMHRGRNRARKSLDQNQTTTTPLTSPSLSFTNNNNPSPTLSSSSSSNSSSTTYSASSSSMDAYSNSNRFGLGGSSSNTRGYFNSHSLDYPYPSTSPKQQQQTLHHASALSLHQNTNSTSQFNVLASATDHKDFRYFQGIGRELEELGEERSFQKHLEAFKILHTIITNNPLATVMNDPYHHCSTDHNKIDHHHTYSSSSSSQHLHHDHDHRQQQCFVLGADMFNKPTRSVLANSSRQDQNQEEDEKDSSESSKKSLHHFFGEDWAQNKNSSDSWLDLSSHSRLDTGS

SEQ ID NO: 1804 - DNA, 1551 bp, Arabidopsis thaliana
  G1438 DNA sequence used for BLAST
atgatgagtctaagtggaagtagcgggagaacaataggaaggcctccatttacaccaacacaatgggaagaactggaacatcaagccctaatctacaagtacatggtctctggtgttcctgtcccacctgagctcatcttctccattagaagaagcttggacacttccttggtctctagactccttcctcaccaatcccgtaagccctatacctatacttaattttctttctttcatgttttcttttcttgcataaagtttcaatcttttgttgattctcatgcccccaaagttttcagctttatgtgttttagagtgatttggtttctggttaaagtctctagctttttttttcaacgaccacttttaaaaactcagtttccacagtcttacttttaatgattttggaacttaaggtcctaattagggttttacatcatgattaattttagggtttcgttttaattaaatgatgcagttggatgggggtgttaccagatgggatttgggagaaaaccagatccagagccaggaagatgcagaagaacagatggtaagaaatggagatgctcaagagaagcttacccagattcgaagtactgtgaaaaacacatgcacagaggaagaaaccgtgccagaaaatctcttgatcagaatcagacaacaacaactcctttaacatcaccatctctctcattcaccaacaacaacaacccaagtcccaccttgtcttcttcttcttcctctaattcctcttctactacttattctgcttcttcttcttcaatggatgcctacagtaacagtaataggtttgggcttggtggaagtagtagtaacactagaggttatttcaacagccattctcttgattatccttatccttctacttcacccaaacaacaacaacaaactcttcatcatgcttccgctttgtcacttcatcaaaatactaattctacttctcagttcaatgtcttagcctctgctactgaccacaaagacttcaggttctgtgatcttatctttagtttctcttgttgatcttttatggaaacttttattgatggattgttttttgaattcaggtactttcaagggattggggagagagttggaggagttggggagagaacgttctttccagaagcatctagaagctttcaagattctccataccatcatcaccaacaaccgttagcaacagtgatgaatgatccgtaccaccactgtagtactgatcataataagattgatcatcatcacacatactcatcctcatcatcatctcaacatcttcatcatgatcatgatcatagacagcaacagtgttttgttttgggcgccgacatgttcaacaaacctacaagaagtgtccttgcaaactcatcaagacaagatcaaaatcaagaagaagatgagaaagattcatcagagtcgtccaagaagtctctacatcacttctttggtgaggactgggcacagaacaagaacagttcagattcttggcttgacctttcttcccactcaagactcgacactggtaattaa

SEQ ID NO: 1805 - DNA, 1774 bp, Arabidopsis thaliana
  G1439 cDNA Sequence
gacgcacaatcccactatccttcgcaagacccttcctctatataaggaagttcatttcatttggagaggacacgctgacaagctgactctagcagatctggtaccctctgaagtgattatttagcactactttttctttgtctccttctgaatccattttttatggatcttggagttcgtgtttctggtcatgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtgaaactggcggccgctctaga

SEQ ID NO: 1806 - protein, 530 aa, Arabidopsis thaliana
  G1439 Amino Acid Sequence
MDLGVRVSGHETVSSPGQTELGSGFSNKQERSGFDGEDCWRSSKLSRTSTDGFSSSPASAKTLSFHQGIPLLRSTTINDPRKGQEHMLSFSSASGKSDVSPYLQYCRNSGYGLGGMMNTSNMHGNLLTGVKGPFSLTQWAELEQQALIYKYITANVPVPSSLLLSLKKSFFPYGSLPPNSFGWGSFHLGFSGGNMDPEPGRCRRTDGKKWRCSRDAVPDQKYCERHINRGRHRSRKPVEGQNGHNTNAAAAASAAAASTAAAVSKAAAGTSAVAMRGSDNNNSLAAAVGTQHHTNNQSTDSLANRVQNSRGASVFPATMNLQSKETHPKQSNNPFEFGLISSDSLLNPSHKQASYATSSKGFGSYLDFGNQAKHAGNHNNVDSWPEELKSDWTQLSMSIPMAPSSPVQDKLALSPLRLSREFDPAIHMGLGVNTEFLDPGKKTNNWIPISWGNNNSMGGPLGEVLNSTTNSPKFGSSPTGVLQKSTFGSLSNSSSASSTIIGDNNNKNGDGKDPLGPTTLMNTSATAPSL

SEQ ID NO: 1807 - DNA, 2273 bp, Arabidopsis thaliana
  G1439 DNA sequence used for BLAST
atgaaaccgtttcttctccgggtcaaactgaactcggatctggtttcagtaacaagcaagaaagatccggtttcgatggtgaagattgctggagaagttcaaagctctcacgaacatcaactgatggattctcttcttcccctgcctctgctaaaacgctgtcgtttcatcaaggcatccctttactgagatctaccactattaatgatcctcgtaaaggacaagaacacatgcttagcttctcttctgcttcaggcaaatcagatgtctcaccttatcttcagtactgtagaaactcaggtctgaactgtaaaaacaactaaagtactctgctttttttttttactttcttgaaaatcagtatatggcttttgcttagagttagattacagaaatgggttttgattagagtttgatttagtgaagtcttgattttggaatattggttttgttgtggtgtcaggatatggtttaggaggaatgatgaacacaagcaacatgcatggaaacttgttgacaggagtaaaaggacctttttcattgactcagtgggcagagctagagcaacaggcgttgatctataagtatatcacagccaatgtccctgttccatctagtttacttctctctctcaagaaatcttttttcccttatggttccttgcctcctaattcttgtaagttctcttccttatcttttgttttcaaagatttgagattattgatcaatagttttgattccttttatctccaatacattagccaagaattaactttatactatcttttttagtgtatagtcctttggaacattgaatcttgtatggattggtggtgggtttattaaagattcttgctttgttaggggaatggtgtttttatgagatcttgagagatttttttgttttgtgtgattatgaagttggatggggctcttttcatctgggcttttccggtggtaacatggatcccgagccagggagatgtcgccggacagatggaaagaaatggcggtgctcgagggacgctgttcccgatcaaaagtactgtgaacgacatattaacagaggccgccatcgttcaagaaagcctgtggaaggccaaaatggccacaatactaatgctgccgccgctgcttctgctgctgccgcttctaccgctgctgctgtgtccaaagcggcagcggggacttcagctgttgcgatgcgtggatcagataataacaatagccttgccgctgctgttggaacacaacatcataccaataatcaatctacagattctttggctaacaggtgaaaacgtttaacatctcttgcctttttgatataacttatctgcatattcttaagtttttaatgttcatacctttttcaacttttaaatacttctttgccctatgagtaagtagtagacccaccaattcattattactacatcttttatgattgtgaccactccttattaatatgaggcttaggattccatatatttggatttttttgctttaatgaactgtttactctccttttcttgatgattcaatgatgtaacaaattaacaagaaatcttaatggttgtttgttgcattgcagagttcaaaattctcgaggggcttcggtttttcctgccacgatgaacttacagtcgaaggaaactcatccgaaacaaagcaataatccctttgaattcggactcatctcttctgattcgttacttaatccgtcgcataaacaagcctcgtatgcaacctcttccaaaggctttggatcgtatcttgacttcggcaaccaagccaagcacgcggggaatcacaacaatgtcgattcttggcccgaagagctgaaatcggattggactcagctctcaatgtcaatccctatggctccatcttcccctgttcaagataaacttgcactctcacctttaaggttatcgcgtgagtttgaccccgcgatccacatgggattaggcgtcaacaccgagtttcttgaccccgggaaaaagacgaataactggataccaatctcctggggtaataacaactccatgggaggtccactcggcgaggtactaaacagcacgaccaatagtcccaagtttggttcctctccaacaggcgtcttgcaaaagtcgacatttggttctctttctaacagcagctcggcaagcagcaccatcattggcgataacaacaataagaacggtgatggaaaagatccgcttggcccgaccacgctgatgaatacttctgctactgctccttctctgtga

SEQ ID NO: 1808 - DNA, 1678 bp, Arabidopsis thaliana
  G1443 cDNA Sequence
ggatgacgcacaatcccactatccttcgcaagacccttcctctatataaggaagttcatttcatttggagaggacacgctgacaagctgactctagcagatctggtaccgtcgacgaggtgggtttttgcttcctctgtgtcgctagtttcaaaagctgtctcctttttcttggaattgaataaagcttccccaaaaatccaatttttgttatgaagatgcagagccctaaaatggagcaggaggaggttgaggaggagaggatgaggaataagtggccgtggatgaaggcggcgcagttaatggagtttcggatgcaagctttggtgtatagatacatagaggctggtctccgtgtgcctcatcatctcgtggtgcctatttggaacagtcttgctctctcttcttcctccaattacaactatcactcttcttctctgttgagtaacaagggagtaacccatatcgacacgttggaaactgaaccaactaggtgcaggagaacagatgggaagaaatggcgctgtagcaacacggtccttctattcgagaagtactgtgaacggcacatgcatagaggtcgtaaacgttcaagaaagcttgtggaatcttcttctgaggttgcttcatcatcaaccaaatacgacaacacttatggtttggataggtataacgagagtcagagtcatcttcatgggacaatctcgggttctagtaatgcgcaggtagttaccattgcttcactgcctagtgccagatcctgtgaaaatgtcattcgtccgtctttagtgatctctgaattcacaaacaaaagtgtgagtcacggcagaaagaacatggagatgagttatgatgactttattaatgaaaaagaggcgagtatgtgtgttggagttgttcctcttcaaggtgatgagagcaaaccttcggttcaaaagttcttccctgaggtatctgataaatgcttagaagctgcaaaattctcaagcaacaggaagaatgatataattgcaagaagcagagaatggaagaatatgaatgttaatggtggtttgtttcatggtatccacttttctccagacactgttcttcaagaacgtggttgttttcgtttacaaggagttgaaacagacaatgaaccaggaaggtgccgaagaacagatgggaagaagtggagatgcagcaaagatgttttgtctggtcagaagtactgcgataagcacatgcatagaggtatgaagaagaagcatccagttgatactactaactcacatgagaatgccgggtttagcccgttaaccgtggaaacagctgttagatcggttgtgccttgcaaagatggagatgaccagaagcattctgtttcagtcatgggaattacactgccccgagtttctgatgagaagagcactagcagttgcagtaccgacactaccattactgacacagctttaaggggtgaagacgacgatgaggagtacttgtctttgttttcaccgggtgtttagaaacatagaaatgttgtcgaggttcaaatgatgtttttagtttcaatctaaggatctttctgtgttagatggcggccgctctagacaggcctcgtaccggatcctctagctagagctttcgttcgtatcatcggtttcgacaacgttcgtcaagttcaatgacatcagttt

SEQ ID NO: 1809 - protein, 431 aa, Arabidopsis thaliana
  G1443 Amino Acid Sequence
MKMQSPKMEQEEVEEERMRNKWPWMKAAQLMEFRMQALVYRYIEAGLRVPHHLVVPIWNSLALSSSSNYNYHSSSLLSNKGVTHIDTLETEPTRCRRTDGKKWRCSNTVLLFEKYCERHMHRGRKRSRKLVESSSEVASSSTKYDNTYGLDRYNESQSHLHGTISGSSNAQVVTIASLPSARSCENVIRPSLVISEFTNKSVSHGRKNMEMSYDDFINEKEASMCVGVVPLQGDESKPSVQKFFPEVSDKCLEAAKFSSNRKNDIIARSREWKNMNVNGGLFHGIHFSPDTVLQERGCFRLQGVETDNEPGRCRRTDGKKWRCSKDVLSGQKYCDKHMHRGMKKKHPVDTTNSHENAGFSPLTVETAVRSVVPCKDGDDQKHSVSVMGITLPRVSDEKSTSSCSTDTTITDTALRGEDDDEEYLSLFSPGV

SEQ ID NO: 1810 - DNA, 1609 bp, Arabidopsis thaliana
  G1443 DNA sequence used for BLAST
acgggctaaacccggcattctcatgtgagttagtagtatcaactggatgcttcttcttcatacctctatgcatgtgcttatcgcagtacttctgaccagacaaaacatctttgctgcatctccacttcttcccatctgttcttcggcaccttcctggttcattgtctgtttcaactccttgtaaacgaaaacaaccacgttctacaacgaagaagcaagatataagacccagaaggtcatgtctgaaaatccctatgaaatgacgataagccaaggttgcaaaggtaaaataccttgaagaacagtgtctggagaaaagtggataccatgaaacaaaccaccattaacattcatattcttccattctctgcttcttgcaattatatcattcttcctgttgcttgagaattttgcagcttctaagcatttatcagatacctcagggaagaacttttgaaccgaaggtttgctctcatcacctagtaatgaaataatggaacctggtcaatccatggagcaatgaagaaatgaattctatagatatttttctgttgtgagtatgatggtatcatgataccttgaagaggaacaactccaacacacatactcgcctctttttcattaataaagtcatcataactcatctccatgttctttctgccgtgactcacacttttgtttgtgaattcagagatcactaaagacggacgaatgacattttcacaggatctggcactaggcagtgaagcaatggtaactacctgcgcattactagaacccgagattgtcccatgaagatgactctgactctcgttatacctatccaaaccataagtgttgtcgtatttggttgatgatgaagcaacctcagaagaagattccacaagctttcttgaacgtttacgacctctatgcatgtgccgttcacagtacttctcgaatagaaggaccgtgttgctacagcgccatttcttcccatctgttctcctgcacctagttggttcagtttccaacgtgtcgatatgggttactcccttgttactcaacactgcaactcaatccccaataggcacaaaatcaaattcagtcaacagaagtttgttgtgtatgtaaatcttttaacttctccaactcagaacccaaaagccaaaaacatgttcaggaagttaaataagcacaataaaacccatcaagcatttccacaacaataccccaaactttacaactgttgaatcagaacataaacttctctagattctgaggtccaagacttgtcgttatgttgtctaaaatcttctaaattgtgtctttttcttaccctagctcaactatcacgcatatactcctaagaatttcttgaaaagaaaactcgaatgtcaaattacttacgagaagaagagtgatagttgtaattggaggaagaagagagagcaagactgttccaaataggcaccacgagatgatgaggcacacggagaccagcctctatgtatctatacaccaaagcttgcatccgaaactccattaactgcgccgccttcatccacggccacttattcctcatcctctcctcctcaacctcctcctgctccattttagggctctgcat

SEQ ID NO: 1811 - DNA, 799 bp, Arabidopsis thaliana
  G1449 cDNA Sequence
tagacagagagaaatagaaatagagagagagagacatgaagagcactctcaatagagaagagaaggaagcatgaagctagctctgcagcttcaaggtctcattaatggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaaaacttggatcggtcaaggctgtgattgcgcagttacgagacgtgtaagatttaggcattgatgaagagacttgaggcgggacggagctattgctgcatattgcaacaaaggccttgaagaagttggagaattgattgatgcatatatttatttatatgacacctttgagtgtgttttttcttataaataaatcacaatatccaagacttctctttaaa

SEQ ID NO: 1812 - protein, 158 aa, Arabidopsis thaliana
  G1449 Amino Acid Sequence
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 1813 - DNA, 675 bp, Arabidopsis thaliana
  G1449 Genomic Sequence
ctagattaattctcctactcctcttcccccacggccgaaacttggcggtggtggcggtgaaacccatgacgtcgtcaccgcctgagaagcttgatcttgcggcggcggaggagtatatccggtattattattgagtagccggatctgccgtttcaagaacttgacatagcgtatagcttcatcgagcattgaagccgtatccattttagtgccacctggcacgagtctctgaagaattctgatcctctcactgattctctcacggcgatgtctagccgccacactctgagggtcgtcggagatcctcacgttacggcgtttgggtttcttgacggttgctgggtcgatgtcaaccgattgcatggctgcgatcttgtacatcatttccttcatagcaccgagttcctctagaggttcttcttcgtcttcgtcgtcttcttgatctccggagagaagagtggtggttgtgagggaagaagagagaggagggaaatgagaagaagagaaaggattgaagatatggagctgtgtgtactggtccatggccataccgattggatcattattatgttgatgatgatgatcatcattcttgttgttgttgttgctgctgttgatgatgttgttccaagtgtaattttggaagagagatgggttcatattataattattcat

SEQ ID NO: 1814 - DNA, 760 bp, Arabidopsis thaliana
  G1449 DNA sequence used for BLAST
ttaatacctctccggtctcgtgatctttagtcttctcacggtttcaagaaacatactaaacaaaaacatcgatttcaaaaattagagaatagctataaccgaggaaattataccaatgtaagatcaagatataagattcatactcccatggaatatctccgaccatcatccaatctccatccttgtcttcatatgtcaaaacatgatgttttcgatctcgattaccgcctgttatagccaagacaatgcatggatatacttcaaactgtttgaatttagttgaatgttgtttttacggaattatgtgttgttcattaattacttacagatgattgaagtatcgaacatgtgagagagattttctaatagactctcgtagcctgagaatacgcaaaggtcgagttttcttccaatgggaacaccttccatataaaccttaacaaagagagaagtgtcatcaccacgacgaagaagacgacgaccctttagtgtatctcttaatctagactttatcggtggccaatcttgtcttgcttctctacaaaaaaataaagatttaaaacacaaatgtgaacaaaagaaaacagagcaaaaacagaacataggaaaaaacagagaagtgatgtgaataagacctttgtggagaagtagaaggaaatgtgagactaagggagagattaacagaagattcagaaggagaaggtttagtactgtcgacagaggatgaagaaaatgaagaacaagagttagagacctccat

SEQ ID NO: 1815 - DNA, 1848 bp, Arabidopsis thaliana
  G1456 cDNA Sequence
tttttttttgtgataacgagagagaaaaaagtgatggacttgtcggttgagaacggaggtttagctccaggttttaggtttcatccgacggacgaagaacttgtcgtctattatctcaaaagaaagatccgtcggaaaaaactcagagtcgaagcaatcggcgagactgatgtctataagtttgatcctgaggaattacctgagaaagcgttgtataagactagagatcgtcaatggttctttttcagcttaagggataggaaacatggaagtaggtcaagtagagctactgaacgtggctattggaaagcaacagggaaggatagagtcattcattgtgattcgagacccgttggagagaagaagactcttgttttccatagaggcagggcacctaatggcgaacggactaattgggtgatgcatgagtatacattgcacaaagaggagctcaagaggtgtggtggtgaagatgttaaggatgcttatgttctttacaagatttataagaaaagtgggtctggtcctaagaatggtgagcaatatggagctccttttattgaagaagaatgggctgaagatgatgatgatgatgttgatgagcctgctaatcagctcgttgtttcggctagtgttgataatagtttatgggggaaagggcttaaccaatctgaattggatgataatgatattgaagagctgatgagtcaggttagagatcagtctggtccaacattgcagcagaatggggtgtctggactgaactctcatgtagacacgtataatctggagaacctggaggaagatatgtatttggaaatcaatgatcttatggaacctgaacctgaaccaacttctgtggaagtcatggagaataactggaacgaggatggttctggtctcctgaatgatgatgatttcgttggtgctgattcatatttccttgatttgggagtgacaaatcctcagttagattttgttagtggtgatttgaaaaatgggtttgcacaaagtcttcaggtgaatacttctttaatgacttaccaggccaataataaccagttccagcagcaatcagggaagaaccaagctagtaactggccactccgtaacagctataccagacagataaacaatggatcatcgtgggtgcaggagctaaacaatgacggacttaccgttacccggtttggtgaggcgcctggtacaggtgattcatctgaattcctaaaccctgttccttctggtataagtacaactaatgaagatgacccgtcaaaagacgagtctagtaagtttgcttctagtgtatggactttcctggaatccattcctgcaaagccagcatatgcatcagagaatccatttgtgaagctgaaccttgttagaatgtcaaccagtggtggtcgtttcaggtttacttctaaaagcacaggtaataatgttgttgttatggatagtgactcagcagtgaagaggaacaagtctggaggaaacaacgataagaagaagaagaagaacaaaggtttcttttgcttatcgatcattggggctttatgtgctttgttttgggtgatcataggaacaatgggaggttcagggaggcctttgttatggtgagaaccgaaaaatccaagaggttaagagacataaaggcttggttttgtgtgaaccattagagagtcaagtcattgtaattattctcttggattattagattcagaagctgtttagtatcacagtttatgcttggaagttttctctggtattggtaaaaaagtaccaatagaaataagcaaaagaattttcttatcttttaaaaaaaaaaaaaaaaaaaaaaaaaaaaaa

SEQ ID NO: 1816 - protein, 528 aa, Arabidopsis thaliana
  G1456 Amino Acid Sequence
MDLSVENGGLAPGFRFHPTDEELVVYYLKRKIRRKKLRVEAIGETDVYKFDPEELPEKALYKTRDRQWFFFSLRDRKHGSRSSRATERGYWKATGKDRVIHCDSRPVGEKKTLVFHRGRAPNGERTNWVMHEYTLHKEELKRCGGEDVKDAYVLYKIYKKSGSGPKNGEQYGAPFIEEEWAEDDDDDVDEPANQLVVSASVDNSLWGKGLNQSELDDNDIEELMSQVRDQSGPTLQQNGVSGLNSHVDTYNLENLEEDMYLEINDLMEPEPEPTSVEVMENNWNEDGSGLLNDDDFVGADSYFLDLGVTNPQLDFVSGDLKNGFAQSLQVNTSLMTYQANNNQFQQQSGKNQASNWPLRNSYTRQINNGSSWVQELNNDGLTVTRFGEAPGTGDSSEFLNPVPSGISTTNEDDPSKDESSKFASSVWTFLESIPAKPAYASENPFVKLNLVRMSTSGGRFRFTSKSTGNNVVVMDSDSAVKRNKSGGNNDKKKKKNKGFFCLSIIGALCALFWVIIGTMGGSGRPLLW

SEQ ID NO: 1817 - DNA, 1948 bp, Arabidopsis thaliana
  G1456 Genomic Sequence
atggacttgtcggttgagaacggaggtttagctccaggttttaggtttcatccgacggacgaagaacttgtcgtctattatctcaaaagaaagatccgtcggaaaaaactcagagtcgaagcaatcggcgagactgatgtctataagtttgatcctgaggaattacctggtacccttcatttcaaatcttctccttactctttaattcatttgatttgctttcgtttacctcaaaattggaatgttttgctctgttttcaagtttcgatttttatctgtttcattcatagattgctcaatttgaacaagcatgattgttacatatgtatgtatggttgattgatttacactctaaaggtttttttttttttagcttctgactttaaaaatggactctttttttttgtgtagagaaagcgttgtataagactagagatcgtcaatggttctttttcagcttaagggataggaaacatggaagtaggtcaagtagagctactgaacgtggctattggaaagcaacagggaaggatagagtcattcattgtgattcgagacccgttggagagaagaagactcttgttttccatagaggcagggcacctaatggcgaacggactaattgggtgatgcatgagtatacattgcacaaagaggagctcaagaggtgtggtggtgaagatgttaaggatgcttatgttctttacaagatttataagaaaagtgggtctggtcctaagaatggtgagcaatatggagctccttttattgaagaagaatgggctgaagatgatgatgatgatgttgatgagcctgctaatcagctcgttgtttcggctagtgttgataatagtttatgggggaaagggcttaaccaatctgaattggatgataatgatattgaagagctgatgagtcaggttagagatcagtctggtccaacattgcagcagaatggggtgtctggactgaactctcatgtagacacgtataatctggagaacctggaggaagatatgtatttggaaatcaatgatcttatggaacctgaacctgaaccaacttctgtggaagtcatggagaataactggaacgaggatggttctggtctcctgaatgatgatgatttcgttggtgctgattcatatttccttgatttgggagtgacaaatcctcagttagattttgttagtggtgatttgaaaaatgggtttgcacaaagtcttcaggtgaatacttctttaatgacttaccaggccaataataaccagttccagcagcaatcagggaagaaccaagctagtaactggccactccgtaacagctataccagacagataaacaatggatcatcgtgggtgcaggagctaaacaatgacggacttaccgttacccggtttggtgaggcgcctggtacaggtacttgaaagcactaacagattttcctgtagatacctcttttcactcgcatactaaatattctatctaattgtgaggaaagcgactggcttcttatcctaatcatattcccttgacaggtgattcatctgaattcctaaaccctgttccttctggtataagtacaactaatgaagatgacccgtcaaaagacgagtctagtaagtttgcttctagtgtatggactttcctggaatccattcctgcaaagccagcatatgcatcagagaatccatttgtgaagctgaaccttgttagaatgtcaaccagtggtggtcgtttcaggtttacttctaaaagcacaggtaataatgttgttgttatggatagtgactcagcagtgaagaggaacaagtctggaggaaacaacgataagaagaagaagaagaacaaaggtttcttttgcttatcgatcattggggctttatgtgctttgttttgggtgatcataggaacaatgggaggttcagggaggcctttgttatggtga

SEQ ID NO: 1818 - DNA, 1948 bp, Arabidopsis thaliana; identical to SEQ ID NO: 1817
  G1456 DNA sequence used for BLAST

SEQ ID NO: 1819 - DNA, 1342 bp, Arabidopsis thaliana
  G1466 cDNA Sequence
caacaagcttcaaaaatgggggaagaagaagagaaccctaattcgatcgacattcttcccgagctacttgaagaagttctccttagattgcccacgaaatcgatcctcaaatgcagaatcgtctcaaaacaatggaggtcactcctggaatcgagtaggttcgcggagaggcatatgagtcttcaaaacagccgccggagaatcttagctgcttacaactgcgactgcggcggacggaggaagctcctacccgagtcacggtttgaaggggacgaagagattgtctatctgcactgcgacgcctcacgaccctcgatgacttgccaaggtgtgatctgcttccccgagcaagattggatcatcgttttgaacccatcgactagccaacttcggcgattcccttccggcttgaaccataactgcagatttagaattggattatggaagactttctctccgggaaactgggtaatggggtttggtagagacaaagtgaatgggaggtataaagtggtgaggatgtcttttgctttctggagagttaggcaagaggagcctgtggtggaatgtggtgttcttgatgttgatactggtgaatggcggaagctgagtccacctccttatgtggtcaatgtgggaagcaaatcggtatgcgtgaatggatctatctactggttacacattcagacggtttacagaatactagccttggatcttcacaaacaagagtttcataaagtcccagtgccgcctacgcagatcactgtggacactcagatggtgaaccttgaggaccgtctcgtacttgctataaccagagttagccctgaatggatactagaggtatggggcatggatacatacaaagaaaaatggagcaagacttactccataagtttggatcatagagttgtttcctggcgaaggcagaaaaggtggttcacgcccgtggcagtttctaagcaagcgaatcttgtcttctatgacaataagaagaggctattcaaatattatccagtgaaagatgagattcgttgtctctccttagacatttgtgttctgtctccttacgtggaaaacttggtccctcttccgttaaagccaagccatccgcatcctactccgaaaaattcagattttgaaatgaggatatcaagatgccgcttgttttcgacgccaggttcttggatatccaaaattttgaaatggaatgttatgactctagagattttgtttacctctctagcaatagttggttatatatgcttacctctctaggagttatttatcttgtttcaaaatattagttggttatatatgctttcgagatctttctgataaa

SEQ ID NO: 1820 - protein, 420 aa, Arabidopsis thaliana
  G1466 Amino Acid Sequence
MGEEEENPNSIDILPELLEEVLLRLPTKSILKCRIVSKQWRSLLESSRFAERHMSLQNSRRRILAAYNCDCGGRRKLLPESRFEGDEEIVYLHCDASRPSMTCQGVICFPEQDWIIVLNPSTSQLRRFPSGLNHNCRFRIGLWKTFSPGNWVMGFGRDKVNGRYKVVRMSFAFWRVRQEEPVVECGVLDVDTGEWRKLSPPPYVVNVGSKSVCVNGSIYWLHIQTVYRILALDLHKQEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 1821 - DNA, 1346 bp, Arabidopsis thaliana
  G1466 Genomic Sequence
ctagagaggtaagcatatataaccaactattgctagagaggtaaacaaaatctctagagtcataacattccatttcaaaattttggatatccaagaacctggcgtcgaaaacaagcggcatcttgatatcctcatttcaaaatctgaatttttcggagtaggatgcggatggcttggctttaacggaagagggaccaagttttccacgtaaggagacagaacacaaatgtctaaggagagacaacgaatctcatctttcactggataatatttgaatagcctcttcttattgtcatagaagacaagattcgcttgcttagaaactgccacgggcgtgaaccaccttttctgccttcgccaggaaacaactctatgatccaaacttatggagtaagtcttgctccatttttctttgtatgtatccatgccccatacctctagtatccattcagggctaactctggttatagcaagtacgagacggtcctcaaggttcaccatctgagtgtccacagtgatctgcgtaggcggcactgggactttatgaaactcttctttgtgaagatccaaggctagtattctgtaaaccgtctgaatgtgtaaccagtagatagatccattcacgcataccgatttgcttcccacattgaccacataaggaggtggactcagcttccgccattcaccagtatcaacatcaagaacaccacattccaccacaggctcctcttgcctaactctccagaaagcaaaagacatcctcaccactttatacctcccattcactttgtctctaccaaaccccattacccagtttcccggagagaaagtcttccataatcctgaaataaagtttcgatttttttctttcaatttctaatggcaaaaatttctacttataaagtaacagattattagttattaccaattctaaatctgcagttatggttcaagccggaagggaatcgccgaagttggctagtcgatgggttcaaaacgatgatccaatcttgctcggggaagcagatcacaccttggcaagtcatcgagggtcgtgaggcgtcgcagtgcagatagacaatctcttcgtccccttcaaaccgtgactcgggtaggagcttcctccgtccgccgcagtcgcagttgtaagcagctaagattctccggcggctgttttgaagactcatatgcctctccgcgaacctactcgattccaggagtgacctccattgttttgagacgattctgcatttgaggatcgatttcgtgggcaatctaaggagaacttcttcaagtagctcgggaagaatgtcgatcgaattagggttctcttcttcttcccccat

SEQ ID NO: 1822 - DNA, 1346 bp, Arabidopsis thaliana; identical to SEQ ID NO: 1821
  G1466 DNA sequence used for BLAST

SEQ ID NO: 1823 - DNA, 927 bp, Arabidopsis thaliana
  G1489 cDNA Sequence
atggaaaagatagctccggagctcttcctcgtcgccggtaacccggactctttcgtcgtcgacgacctcctcgacttctctaacgacgacggcgaagttgacgacggcttaaacactcttcccgattcttcaacactctccaccggcactctcaccgacagttccaactcctcctcgcttttcaccgacggcactggcttctccgacctatatattccgaatgacgatatagcagaattagaatggttatcaaattttgtggaagaatcattcgcaggagaagaccaagacaagcttcacttattttccggtttaaaaaaccctcaaaccaccgggtcgaccctgacccacttaattaaacccgaacccgaacttgatcatcaattcatcgacatcgatgaatccaacgtcgccgttcctgccaaggccagaagcaagagatcacgttctgcagcctccacgtgggcttcccgtcttttatccttagccgattccgacgaaaccaatcccaagaagaaacaacgaagagtgaaagaacaagacttcgccggagatatggacgtggattgcggagaaagcggaggaggacgacgttgtttgcactgcgcgacggagaagacgccgcaatggaggacgggacctatgggtccgaagacgctttgtaacgcttgcggagtgaggtacaaatcagggaggctcgtgccggagtatagaccggcgtcgagtccgacgttcgtgatggcgaggcactcgaactctcaccggaaagtgatggagctccggcgacagaaggagatgagagacgagcatttgctgagtcagcttaggtgtgagaatctactgatggatatcagatccaacggtgaagatttcttaatgcataataatactaaccacgtggctcctgattttagacacttaatctag

SEQ ID NO: 1824 - protein, 308 aa, Arabidopsis thaliana
  G1489 Amino Acid Sequence
MEKIAPELFLVAGNPDSFVVDDLLDFSNDDGEVDDGLNTLPDSSTLSTGTLTDSSNSSSLFTDGTGFSDLYIPNDDIAELEWLSNFVEESFAGEDQDKLHLFSGLKNPQTTGSTLTHLIKPEPELDHQFIDIDESNVAVPAKARSKRSRSAASTWASRLLSLADSDETNPKKKQRRVKEQDFAGDMDVDCGESGGGRRCLHCATEKTPQWRTGPMGPKTLCNACGVRYKSGRLVPEYRPASSPTFVMARHSNSHRKVMELRRQKEMRDEHLLSQLRCENLLMDIRSNGEDFLMHNNTNHVAPDFRHLI

SEQ ID NO: 1825 - DNA, 1018 bp, Arabidopsis thaliana
  G1489 DNA sequence used for BLAST
atggaaaagatagctccggagctcttcctcgtcgccggtaacccggactctttcgtcgtcgacgacctcctcgacttctctaacgacgacggcgaagttgacgacggcttaaacactcttcccgattcttcaacactctccaccggcactctcaccgacagttccaactcctcctcgcttttcaccgacggcactggcttctccgacctatatattccggtaattttccgttattattttctcaaatccacgccaatatttatgaaatagtaacacttttttcttcttcttcttcttcttatttaatcagaatgacgatatagcagaattagaatggttatcaaattttgtggaagaatcattcgcaggagaagaccaagacaagcttcacttattttccggtttaaaaaaccctcaaaccaccgggtcgaccctgacccacttaattaaacccgaacccgaacttgatcatcaattcatcgacatcgatgaatccaacgtcgccgttcctgccaaggccagaagcaagagatcacgttctgcagcctccacgtgggcttcccgtcttttatccttagccgattccgacgaaaccaatcccaagaagaaacaacgaagagtgaaagaacaagacttcgccggagatatggacgtggattgcggagaaagcggaggaggacgacgttgtttgcactgcgcgacggagaagacgccgcaatggaggacgggacctatgggtccgaagacgctttgtaacgcttgcggagtgaggtacaaatcagggaggctcgtgccggagtatagaccggcgtcgagtccgacgttcgtgatggcgaggcactcgaactctcaccggaaagtgatggagctccggcgacagaaggagatgagagacgagcatttgctgagtcagcttaggtgtgagaatctactgatggatatcagatccaacggtgaagatttcttaatgcataataatactaaccacgtggctcctgattttagacacttaatctag

SEQ ID NO: 1826 - DNA, 1306 bp, Arabidopsis thaliana
  G1496 cDNA Sequence
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 1827 - protein, 335 aa, Arabidopsis thaliana
  G1496 Amino Acid Sequence
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 1828 - DNA, 1425 bp, Arabidopsis thaliana
  G1496 Genomic Sequence
atgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggtttgtaagatcaaaattttggataaaaactttgttttgagacatggtttttgatattttttattaataatgtcttaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggtaataaaaataaataagtttcttgtgatacaagaatcatgatatatctagggtttctgaatggatttggatttgcaggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgaggtaagcaatgaaaccatgattctctgtaacttaacttcactattaaccaaagagaataagtctaattcttaaagagccatactttgcagttcctgtcgatgaaacttgctgtcttgaacccggaactagagcttgccgtggaagatgtatccgtaaaacaggtgaaaacacattgtctagaccctcaaagtcatattgatattgctcaacaaacttaagggttatgaaattttcagtttcaggcttactttacaaatgtagttgcttcaaagcaatcaataatggttgatgtgccattgtttccgttagaccagcaaggatctctagatttgtctgcgataaacccgaaccaaacgacatctatcgaagctgtaagtacagctttatatgaaactgaaaaacttgtcagagtttttgttccttgtcagtgaagtaacctgtctctgtatctctctatttcagccatctggaagctgggaaactcaatcacagagtctctacaacacatctagcctcggttttcattactaa

SEQ ID NO: 1829 - DNA, 1401 bp, Arabidopsis thaliana
  G1496 DNA sequence used for BLAST
atgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggtttgtaagatcaaaattttggataaaaactttgttttgagacatggtttttgatattttttattaataatgtcttaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggtaataaaaataaataagtttcttgtgatacaagaatcatgatatatctagggtttctgaatggatttggatttgcaggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgaggtaagcaatgaaaccatgattctctgtaacttaacttcactattaaccaaagagaataagtctaattcttaaagagccatactttgcagttcctgtcgatgaaacttgctgtcttgaacccggaactagagcttgccgtggaagatgtatccgtaaaacaggtgaaaacacattgtctagaccctcaaagtcatattgatattgctcaacaaacttaagggttatgaaattttcagtttcaggcttactttacaaatgtagttgcttcaaagcaatcaataatggttgatgtgccattgtttccgttagaccagcaaggatctctagatttgtctgcgataaacccgaaccaaacgacatctatcgaagctgtaagtacagctttatatgaaactgaaaaacttgtcagagtttttgttccttgtcagtgaagtaacctgtctctgtatctctctatttcagccatctggaagctgggaaactcaatcacagagtctctacaacaca

SEQ ID NO: 1830 - DNA, 902 bp, Arabidopsis thaliana
  G1499 cDNA Sequence
tcgactccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 1831 - protein, 224 aa, Arabidopsis thaliana
  G1499 Amino Acid Sequence
MNNYNMNPSLFQNYTWNNIINSSNNNNKNDDHHHQHNNDPIGMAMDQYTQLHIFNPFSSSHFPPLSSSLTTTTLLSGDQEDDEDEEEPLEELGAMKEMMYKIAAMQSVDIDPATVKKPKRRNVRISDDPQSVAARHRRERISERIRILQRLVPGGTKMDTASMLDEAIRYVKFLKRQIRLLNNNTGYTPPPPQDQASQAVTTSWVSPPPPPSFGRGGRGVGELI

SEQ ID NO: 1832 - DNA, 675 bp, Arabidopsis thaliana; identical to SEQ ID NO: 1813
  G1499 Genomic Sequence

SEQ ID NO: 1833 - DNA, 675 bp, Arabidopsis thaliana; identical to SEQ ID NO: 1813
  G1499 DNA sequence used for BLAST

SEQ ID NO: 1834 - DNA, 1533 bp, Arabidopsis thaliana
  G1509 cDNA Sequence
atggggaagcaaggaccttgctaccactgtggagttacaaacacacctttgtggagaaatggaccaccagagaagccggtattgtgcaatgcgtgtggatcgcgttggaggacaaagggaacacttgtgaactacacaccgcttcatgctcgtgctgatggtgatgagaatgatgatcatcacaggtttcaaagaatgaagagcatttctttaggcaataagaacaaagagataaagatgctcaagaggaaagcaattcaagaaaacatcatcattaaaagaccggtctttgaattcagttatggtttgaaggcggctgtgatagaggaggatgctagtaatagatcgagttccggttcggctgtatcaaactctgagagctgtgcacagtttagcagtgcagatgggagtccatctcaatctaatgcgtgggacacaactgttccttgcaagaggaggacgtgtgtgggccgtcctaagtcctcttctgttgaaaagctcacaaaggacctttacaatattttacaagagcagcaatcgtcatgtctctcagtttcatcagaggaagatcttctttttgagaatgaaatgtcaatggtctcagttgagattggacatgggagtgttctgatgaagaatccccactcgtttgctcgggaagaggagtctgaagccagctcactctcttcgattgagaacaagtcctccatcagtgacgcatactcacattccgtgaagcgtgttgagattggagcagtgagaggttcatattatggtggacaaacaataaagcaagaacaattcaagagaaccaagtctcaaactgaaagagtgcatgtcctggggagtcatggttcaccactatgtagcatagatttgaaggatgttttcaactttgatgagttcatagaacaattcacagaggaagaacagaagaaactgatgaacttgcttcctcagattgactctgatgaccttcctcatagcctcagaatgatgtttgaaagtgctcagttcaaggacaacttctctttgtttcagcagctcattgctgatggtgtctttgatgtgtcttcttcctcgggggcaaaactcgaagaaatcaggacttttaagaagcttgctttgacagattttaacaaatctcgtttggtggaaagctataacctcctcaaggaacgcgaaaaagggaccggagattctgttactacaacttcaaaaagctcaatcccaaatgtacctaaaaatattgtaaccattaagaggcgctatgaaaaccaaatccaagtaaagtcagagtcaagggggctaatgaggagccccaaaagggtgatgaagatgaaagcaagccatgagacagagaacaatgtctcatgcttcagaccaagaagcttggcttctgtgtttgcacaagaaggtggctctgcagtgtttagctatgaaggtaattgcagttctgatcaagatctccttcttctggacttgccgtcaaacgggtcatttcctcaagcagagctacttcaccaactctga

SEQ ID NO: 1835 - protein, 510 aa, Arabidopsis thaliana
  G1509 Amino Acid Sequence
MGKQGPCYHCGVTNTPLWRNGPPEKPVLCNACGSRWRTKGTLVNYTPLHARADGDENDDHHRFQRMKSISLGNKNKEIKMLKRKAIQENIIIKRPVFEFSYGLKAAVIEEDASNRSSSGSAVSNSESCAQFSSADGSPSQSNAWDTTVPCKRRTCVGRPKSSSVEKLTKDLYNILQEQQSSCLSVSSEEDLLFENEMSMVSVEIGHGSVLMKNPHSFAREEESEASSLSSIENKSSISDAYSHSVKRVEIGAVRGSYYGGQTIKQEQFKRTKSQTERVHVLGSHGSPLCSIDLKDVFNFDEFIEQFTEEEQKKLMNLLPQIDSDDLPHSLRMMFESAQFKDNFSLFQQLIADGVFDVSSSSGAKLEEIRTFKKLALTDFNKSRLVESYNLLKEREKGTGDSVTTTSKSSIPNVPKNIVTIKRRYENQIQVKSESRGLMRSPKRVMKMKASHETENNVSCFRPRSLASVFAQEGGSAVFSYEGNCSSDQDLLLLDLPSNGSFPQAELLHQL

SEQ ID NO: 1836 - DNA, 2646 bp, Arabidopsis thaliana
  G1509 DNA sequence used for BLAST
tcagagttggtgaagtagctctgcttgaggaaatgacccgtttgacggcaagtccagaagaaggagatcttgatcagaactgcaattaccttcatagctaaacactgcagagccaccttcttgtgcaaacacagaagccaagcttcttggtctgaagcatgagacattgttctctgtctcatggcttgctttcatcttcatcacccttttggggctcctcattagcccccttgactctgtgaccacaacaagaaactcaacaaaccacaaagattgattgcagaatcagcaagactgattgaaattgtccttaagactgacctgactttacttggatttggttttcatagcgcctcttaatggttacaatatttttaggtacatttgggattgagctttttgaagttgtagtaacagaatctccggtccctttttcgcgttcctgtagtcacatatccggtgaatctctggccaaaagttattattatgtcagtgtttcaatgagagtaagcccaaccttgaggaggttatagctttccaccaaacgagatttgttaaaatctgtcaaagcaagcttcttaaaagtcctgatttcttcgagttttgcccccgaggaagaagacacatcaaagacaccatcagcaatgagctgctgaaacaaagagaagttgtccttgaactgagcactttcaaacatcattctgaggctgcaaaggcataatatgacagattataaattttgtacggtctggtttagttgttttaagaaaaaatgcaatgcggtttgaacctatgaggaaggtcatcagagtcaatctgaggaagcaagttcatcagtttcttctgttcttcctctgtgaattgttctatgaactcatcaaagttgaaaacatcctgcaagaagtttattgtttaggcattgtcctggagtcatttttaaaaatttgactttcatatgcaaatatttaacttattgaacagacttggtgagagttgcttgaaacttaccttcaaatctatgctacatagtggtgaaccatgactccccaggacatgcactctttcagtttgagacttggttctgccaaccattaaaaacaggatccattattatccttaactaaactgagagctaatgtatagaatatcttgaagatacaataaaaatactttacctcttgaattgttcttgctttattgtttgtccaccataatatgaacctctcactgctccaatctcaacacgcttcacggaatgtgagtatgcgtcactgatggaggacttgttctcaatcgaagagagtgagctggcttcagactcctcttcccgagcaaacgagtggggattcttcatcagaacactcccatgtccaatctcaactgagaccattgacatttcattctcaaaaagaagatcttcctctgatgaaactgagagacatgacgattgctgctcttgtaaaatattgtaaaggtcctttgtgagcttttcaacagaagaggacttaggacggcccacacacgtcctcctcttgcaaggaacagttgtgtcccacgcattagattgagatggacctggaaaaacaaagttcacatggacacttttaaaaatcccatattgttgatcaaccggaagaataataaagtaactaaacctgttaactcactcccatctgcactgctaaactgtgcacagctctcagagtttgatacagccgaaccggaactcgatctattactagcatcctcctctatcacagccgccttcaaaccataactgaattcaaagaccggtcttttaatgatgatgttttcttgaattgctttcctcttgagcatctttatctctttgttcttattgcctaaagaaatgctcttcattctttgaaacctgtgatgatcatcattctcatcaccatcagcacgagcatgaagcggtgtgtagttcacaagtgttccctttgtcctccaacgcgatccacacgcattgcacaataccggcttctctggtggtccatttctccacaaaggtgtgtctgtttcaatgaaagaaacaaaatttcacaaatttgagctttgaaatcaagacaacataagagttcaacatcagacaacacttgaaatgtgacttaatactgcaaattcaaactccaaatcaatcagaagaacaatgatctcaaaacaccaaacatcttaaagtctttaagcagcaaccagaacaaaatttagcttctttgtacaacaattgcgaatcataaacacaaattcagatcccaagatcatgtctttgttgcctaatccattagttctaatcatactgagaacaacaacacaagtcacaaacagttgttacttaagatcattcaacagaaacaatatatatagttaaaggaacataattccaaaatgttcatagatattcttgagtccaggaagtctttgctgtatcacttcaatcattattacaatttgctacacaaaaagcatataatcaaatcattttcccagaaaagagagcatctcacccagaagtaaaaaaaacaaaggttgaatattcatattcatacagattttcacatcatcaaataggaattggagacactcacttgtaactccacagtggtagcaaggtccttgcttccccat

SEQ ID NO: 1837 - DNA, 1233 bp, Arabidopsis thaliana
  G1514 cDNA Sequence
atggccgaaactatgaaagatattacgatgaagaacgatgaatcacaggaagaagaaatccccgatcaatttctctgctgcgtttgcctggaacttctttacaagccaattgtgttatcttgtggtcatctatcatgtttttggtgcgtacataagtccatgaatggctttcgtgagtctcattgtccgatatgtagagacccgtatgttcactttccctctgtgtgccagaagctttattttctgttaaagaagatgtacccacttgctcataagaagagagaagaacaagttttaaaggaagagcaagaacgagaatgtttttctcctcagattgatcttgttttggatttgtctgtgtgtagtggagattctctcaatgtctctgataaacagaaggtggaagagtgttcgaatgcagcgaacttattatctagttcatcaagtagaggtgacattccatgtatccccaaaaatcaagaacccacagatgcaaaagctcttaatgttcatgaaaatgaattacttaaggataacaaagtcagtaagcagatttcgaaagatgatttgctctgttcagcatgtaaggagctgcttgtacgacccgtagttctcaattgcggacatgtgtattgtgaaggatgtgtagtagatatggctgaagaaagcgaaaagatcaaatgtcaagagtgtaatgtttgtgacccaagaggatttccaaaagtttgtttgattcttgaacagcttttggaggaaaactttcctgaagaatacaattcaagaagcagtaaggttcagaaaacgctcgcccataatagcaaaggaaatattcaaagctatctcaaagaaggcccgtccttatcaaacgacaataacaatgatgatccctggttggcaaaccctggatcaaatgttcactttggagctggttgtgattcttgtggggtgtatccaatcataggggatcgatacagatgcaaagactgcaaggaggaaattgggtatgacctttgcaaagactgttacgagactccttcgaaagttccagggagattcaaccagcaacacactcctgaccacaggcttgagcttgcacggtctcctcaggttctgatcaatttcaattctatcggtatccttctcggacccgttatctcaaatgaaggcatggatacagatgaaggcgaggaagggcctcctggttcttctaatgagtcatcaagcacagaatga

SEQ ID NO: 1838 - protein, 410 aa, Arabidopsis thaliana
  G1514 Amino Acid Sequence
MAETMKDITMKNDESQEEEIPDQFLCCVCLELLYKPIVLSCGHLSCFWCVHKSMNGFRESHCPICRDPYVHFPSVCQKLYFLLKKMYPLAHKKREEQVLKEEQERECFSPQIDLVLDLSVCSGDSLNVSDKQKVEECSNAANLLSSSSSRGDIPCIPKNQEPTDAKALNVHENELLKDNKVSKQISKDDLLCSACKELLVRPVVLNCGHVYCEGCVVDMAEESEKIKCQECNVCDPRGFPKVCLILEQLLEENFPEEYNSRSSKVQKTLAHNSKGNIQSYLKEGPSLSNDNNNDDPWLANPGSNVHFGAGCDSCGVYPIIGDRYRCKDCKEEIGYDLCKDCYETPSKVPGRFNQQHTPDHRLELARSPQVLINFNSIGILLGPVISNEGMDTDEGEEGPPGSSNESSSTE

SEQ ID NO: 1839 - DNA, 1514 bp, Arabidopsis thaliana
  G1514 DNA sequence used for BLAST
tgccgcaaaagcaaaagctatcgccaccaccgtgtcataaatctcagatctctctctctctctctctctctctctctctctctctctctctctctctctctctctctctcttgcgataacaatggccgaaactatgaaagatattacgatgaagaacgatgaatcacaggaagaagaaatccccgatcaatttctctgctgcgtttgcctggaacttctttacaagccaattgtgttatcttgtggtcatctatcatgtttttggtgcgtacataagtccatgaatggctttcgtgagtctcattgtccgatatgtagagacccgtatgttcactttccctctgtgtgccagaagctttattttctgttaaagaagatgtacccacttgctcataagaagagagaagaacaagttttaaaggaagagcaagaacgagaatgtttttctcctcagattgatcttgttttggatttgtctgtgtgtagtggagattctctcaatgtctctgataaacagaaggtggaagagtgttcgaatgcagcgaacttattatctagttcatcaagtagaggtgacattccatgtatccccaaaaatcaagaacccacagatgcaaaagctcttaatgttcatgaaaatgaattacttaaggataacaaagtcagtaagcagatttcgaaagatgatttgctctgttcagcatgtaaggagctgcttgtacgacccgtagttctcaattgcggacatgtgtattgtgaaggatgtgtagtagatatggctgaagaaagcgaaaagatcaaatgtcaagagtgtaatgtttgtgacccaagaggatttccaaaagtttgtttgattcttgaacagcttttggaggaaaactttcctgaagaatacaattcaagaagcagtaaggttcagaaaacgctcgcccataatagcaaaggaaatattcaaagctatctcaaagaaggcccgtccttatcaaacgacaataacaatgatgatccctggttggcaaaccctggatcaaatgttcactttggagctggttgtgattcttgtggggtgtatccaatcataggggatcgatacagatgcaaagactgcaaggaggaaattgggtatgacctttgcaaagactgttacgagactccttcgaaagttccagggagattcaaccagcaacacactcctgaccacaggcttgagcttgcacggtctcctcaggttctgatcaatttcaattctatcggtatccttctcggacccgttatctcaaatgaaggcatggatacagatgaaggcgaggaagggcctcctggttcttctaatgagtcatcaagcacagaatgaaatagcagtcaagtattaatgcatatgctttcgctttgtgtttgcgtttgttattgtatttatacttcataatatattttctcctgagaagtctatggttttaacattttaaacaaagtttatttcttaacaaaaaaaaaaaaaaaaaaaaaaaaaaaaa

SEQ ID NO: 1840 - DNA, 2028 bp, Arabidopsis thaliana
  G1518 cDNA Sequence
atggaagagatttcgacggatccggttgttccagcggtgaaacctgacccgagaacatcttcagttggtgaaggtgctaatcgtcatgaaaatgacgacggaggaagcggcggttctgagattggagcaccggatctggataaagacttgctttgtccgatttgtatgcagattattaaagatgctttcctcacggcttgtggtcatagtttctgctatatgtgtatcatcacacatcttaggaacaagagtgattgtccctgttgtagccaacacctcaccaataatcagctttaccctaatttcttgctcgataagctattgaagaaaacttcagctcggcatgtgtcaaaaactgcatcgcccttggatcagtttcgggaagcactacaaaggggttgtgatgtgtcaattaaggaggttgataatcttctgacacttcttgcggaaaggaagagaaaaatggaacaggaagaagctgagaggaacatgcagatacttttggactttttgcattgtctaaggaagcaaaaagttgatgaactaaatgaggtgcaaactgatctccagtatattaaagaagatataaatgccgttgagagacatagaatagatttataccgagctagggacagatattctgtaaagttgcggatgctcggagatgatccaagcacaagaaatgcatggccacatgagaagaaccagattggtttcaactccaattctctcagcataagaggaggaaattttgtaggcaattatcaaaacaaaaaggtagaggggaaggcacaaggaagctctcatgggctaccaaagaaggatgcgctgagtgggtcagattcgcaaagtttgaatcagtcaactgtctcaatggctagaaagaaacggattcatgctcagttcaatgatttacaagaatgttacctccaaaagcggcgtcagttggcagaccaaccaaatagtaaacaagaaaatgataagagtgtagtacggagggaaggctatagcaacggccttgcagattttcaatctgtgttgactaccttcactcgctacagtcgtctaagagttatagcagaaatccggcatggggatatatttcattcagccaacattgtatcaagcatagagtttgatcgtgatgatgagctgtttgccactgctggtgtttctagatgtataaaggtttttgacttctcttcggttgtaaatgaaccagcagatatgcagtgtccgattgtggagatgtcaactcggtctaaacttagttgcttgagttggaataagcatgaaaaaaatcacatagcaagcagtgattatgaaggaatagtaacagtgtgggatgtaactactaggcagagtcttatggagtatgaagagcacgaaaaacgtgcctggagtgttgacttttcacgaacagaaccatcaatgcttgtatctggtagtgacgactgcaaggttaaagtttggtgcacgaggcaggaagcaagtgtgattaatattgatatgaaagcaaacatatgttgtgtcaagtacaatcctggctcaagcaactacattgcggtcggatcagctgatcatcacatccattattacgatctaagaaacataagccaaccacttcatgtcttcagtggacacaagaaagcagtttcctatgttaaatttttgtccaacaacgagctcgcttctgcgtccacagatagcacactacgcttatgggatgtcaaagacaacttgccagttcgaacattcagaggacatactaacgagaagaactttgtgggtctcacagtgaacagcgagtatctcgcctgtggaagcgagacaaacgaagtatatgtatatcacaaggaaatcacgagacccgtgacatcgcacagatttggatcgccagacatggacgatgcagaggaagaggcaggttcctactttattagtgcggtttgctggaagagtgatagtcccacgatgttgactgcgaatagtcaaggaaccatcaaagttctggtactcgctgcgtga

SEQ ID NO: 1841 - protein, 675 aa, Arabidopsis thaliana
  G1518 Amino Acid Sequence
MEEISTDPVVPAVKPDPRTSSVGEGANRHENDDGGSGGSEIGAPDLDKDLLCPICMQIIKDAFLTACGHSFCYMCIITHLRNKSDCPCCSQHLTNNQLYPNFLLDKLLKKTSARHVSKTASPLDQFREALQRGCDVSIKEVDNLLTLLAERKRKMEQEEAERNMQILLDFLHCLRKQKVDELNEVQTDLQYIKEDINAVERHRIDLYRARDRYSVKLRMLGDDPSTRNAWPHEKNQIGFNSNSLSIRGGNFVGNYQNKKVEGKAQGSSHGLPKKDALSGSDSQSLNQSTVSMARKKRIHAQFNDLQECYLQKRRQLADQPNSKQENDKSVVRREGYSNGLADFQSVLTTFTRYSRLRVIAEIRHGDIFHSANIVSSIEFDRDDELFATAGVSRCIKVFDFSSVVNEPADMQCPIVEMSTRSKLSCLSWNKHEKNHIASSDYEGIVTVWDVTTRQSLMEYEEHEKRAWSVDFSRTEPSMLVSGSDDCKVKVWCTRQEASVINIDMKANICCVKYNPGSSNYIAVGSADHHIHYYDLRNISQPLHVFSGHKKAVSYVKFLSNNELASASTDSTLRLWDVKDNLPVRTFRGHTNEKNFVGLTVNSEYLACGSETNEVYVYHKEITRPVTSHRFGSPDMDDAEEEAGSYFISAVCWKSDSPTMLTANSQGTIKVLVLAA

SEQ ID NO: 1842 - DNA, 2331 bp, Arabidopsis thaliana
  G1518 DNA sequence used for BLAST
caaaaaccaaaatcacaatcgaagaaatcttttgaaagcaaaatggaagagatttcgacggatccggttgttccagcggtgaaacctgacccgagaacatcttcagttggtgaaggtgctaatcgtcatgaaaatgacgacggaggaagcggcggttctgagattggagcaccggatctggataaagacttgctttgtccgatttgtatgcagattattaaagatgctttcctcacggcttgtggtcatagtttctgctatatgtgtatcatcacacatcttaggaacaagagtgattgtccctgttgtagccaacacctcaccaataatcagctttaccctaatttcttgctcgataagctattgaagaaaacttcagctcggcatgtgtcaaaaactgcatcgcccttggatcagtttcgggaagcactacaaaggggttgtgatgtgtcaattaaggaggttgataatcttctgacacttcttgcggaaaggaagagaaaaatggaacaggaagaagctgagaggaacatgcagatacttttggactttttgcattgtctaaggaagcaaaaagttgatgaactaaatgaggtgcaaactgatctccagtatattaaagaagatataaatgccgttgagagacatagaatagatttataccgagctagggacagatattctgtaaagttgcggatgctcggagatgatccaagcacaagaaatgcatggccacatgagaagaaccagattggtttcaactccaattctctcagcataagaggaggaaattttgtaggcaattatcaaaacaaaaaggtagaggggaaggcacaaggaagctctcatgggctaccaaagaaggatgcgctgagtgggtcagattcgcaaagtttgaatcagtcaactgtctcaattgctagaaagaaacggattcatgctcagttcaatgatttacaagaatgttacctccaaaagcggcgtcagttggcagaccaaccaaatagtaaacaagaaaatgataagagtgtagtacggagggaaggctatagcaacggccttgcagattttcaatctgtgttgactaccttcactcgctacagtcgtctaagagttatagcagaaatccggcatggggatatatttcattcagccaacattgtatcaagcatagagtttgatcgtgatgatgagctgtttgccactgctggtgtttctagatgtataaaggtttttgacttctcttcgtttgtaaatgaaccagcagatatgcagtgtccgattgtggagatgtcaactcggtctaaacttagttgcttgagttggaataagcatgaaaaaaatcacatagcaagcagtgattatgaaggaatagtaacagtgtgggatgtaactactaggcagagtcggatggagtatgaagagcacgaaaaacgtgcctggagtgttgacttttcacgaacagaaccatcaatgcttgtatctggtagtgacgactgcaaggttaaagtttggtgcacgaggcaggaagcaagtgtgattaatattgatatgaaagcaaacatatgttgtgtcaagtacaatcctggctcaagcaactacattgcggtcggatcagctgatcatcacatccattattacgatctaagaaacataagccaaccacttcatgtcttcagtggacacaagaaagcagtttcctatgttaaatttttgtccaacaacgagctcgcttctgcgtccacagatagcacactacgcttatgggatgtcaaagacaacttgccagttcgaacattcagaggacatactaacgagaagaactttgtgggtctcacagtgaacagcgagtatctcgcctgtggaagcgagacaaacgaagtatatgtatatcacaaggaaatcacgagacccgtgacatcgcacagatttggatcgccagacatggacgatgcagaggaagaggcaggttcctactttattagtgcggtttgctggaagagtgatagtcccacgatgttgactgcgaatagtcaaggaaccatcaaagttctggtactcgctgcgtgattctagtagacattacaaaagatcttatagcttcgtgaatcaataaaaacaaatttgccgtctatgttctttagtgggagttacatatagagagagaacaatttattaaaagtagggttcatcatttggaaagcaactttgtattattatgcttgccttggaacactcctcaagaagaatttgtatcagtgatgtagatatgtcttacggtttcttagcttctactttatataattaaatgttagaatcaaaaaaaaaaaa

SEQ ID NO: 1843 - DNA, 1146 bp, Arabidopsis thaliana
  G1519 cDNA Sequence
atgaggcttaatggggattcgggtccgggtcaggatgaacccggttcgagcgggtttcacggcggaatcagacgattcccgttagcagctcagccggagattatgagagctgctgagaaagacgatcaatacgcttctttcatccacgaagcttgccgcgatgccttccgacaccttttcggtacaagaatcgctcttgcttaccagaaggagatgaagctacttggacagatgctttactatgttcttacgacaggttcagggcaacaaactttaggagaggaatattgtgacattatacaggttgcagggccttatggactctctcctacaccagctagacgtgctttgttcatattgtaccagaccgcagttccatatatcgcagagagaattagcactcgagctgctacgcaagcagtcacctttgatgagtctgatgagttttttggtgatagtcatatccactcaccaagaatgatagatcttccatcttcatctcaagttgaaacttcaacttctgtagtatctaggttaaacgatagacttatgagatcgtggcaccgagctattcagcgatggcctgtggttcttcctgttgcccgcgaagtcttacaactggttttgcgtgccaatctgatgctcttctactttgaaggtttttattatcatatatcgaaacgtgcatccggggttcgttatgttttcataggaaagcaactgaatcagagacctagataccaaattcttggggttttccttctaatccaattgtgcatccttgctgctgagggcttgcgtcggagtaatttgtcatctatcactagctccattcagcaggcttctataggatcttatcaaacttcaggagggagaggtttacctgttttaaatgaagaggggaatttgataacttcggaagctgaaaagggaaactggtctacctccgattcaacttcaacggaggcagtagggaaatgcactctctgcttaagcacccgtcagcacccaacggccactccttgtggtcatgtgttttgttggagctgcattatggaatggtgcaacgagaagcaagaatgccctctttgtcgaacgcccaatacccattcaagtttggtttgtttgtatcattctgatttttag

SEQ ID NO: 1844 - protein, 381 aa, Arabidopsis thaliana
  G1519 Amino Acid Sequence
MRLNGDSGPGQDEPGSSGFHGGIRRFPLAAQPEIMRAAEKDDQYASFIHEACRDAFRHLFGTRIALAYQKEMKLLGQMLYYVLTTGSGQQTLGEEYCDIIQVAGPYGLSPTPARRALFILYQTAVPYIAERISTRAATQAVTFDESDEFFGDSHIHSPRMIDLPSSSQVETSTSVVSRLNDRLMRSWHRAIQRWPVVLPVAREVLQLVLRANLMLFYFEGFYYHISKRASGVRYVFIGKQLNQRPRYQILGVFLLIQLCILAAEGLRRSNLSSITSSIQQASIGSYQTSGGRGLPVLNEEGNLITSEAEKGNWSTSDSTSTEAVGKCTLCLSTRQHPTATPCGHVFCWSCIMEWCNEKQECPLCRTPNTHSSLVCLYHSDF

SEQ ID NO: 1845 - DNA, 2648 bp, Arabidopsis thaliana
  G1519 DNA sequence used for BLAST
taaaaatcagaatgatacaaacaaaccaaacttgaatgggtattgggcgttcgacaaagagggcattcttgcttctcgttgcaccattccataatgcagctcctgcacatgacaacatgactttcaaaatgagcacaatgttccggtgtcaacttttggatcttaggttttgtagttcgagtaaatgttcgatacaaagttcatcttatcaaaagcagtttcaaccaatggacatcaagatattgaaattctctggattctgaaacttatcaaggtttgtaggtgttaactcgttccagatcaggcccaggacaaaataagcaattacggtagaggaaggtttattaccaacaaaacacatgaccacaaggagtggccgttgggtgctgacgggtgcttaagcagagagtgcatttccctactgcctgcaatcgaagtacatagcaaggtaaacacctaacataacaagtggtaacatattgatttcatcaaaacgagagaaaaataaacccctctggagtttttttaaatttagaatagtctcaaaataggattaacatataaccttgtctcgctagaaactatatgtagagcgggatcagtcgagtggccatctactcttatcagatactcataccaacagagtaaactatcattttggttttcttaatcacacttatacaacataacctttgcgtaagagcataatacattttgctcagagttatgtgcctctcttccaagtatattattacctattgtcctttcccaataatgatcactattcaagatattagccattacaaagtaacagaagtttctaacttatttataaatattttacctccgttgaagttgaatcggaggtagaccagtttcccttttcagcttccgaagttatcaaattcccctcttcatttaaaacaggtaaacctctccctgcaagaacaataccaaaactatattactgtaatgtgaaatagggtgatgcataacaagcagaatatttcagcctatgttatcttctctcatgtatctttctaacaaacttttaccatgatgccaatttagaccatagtttattgaaactatagtactgacaatctaacatatatatcctccacaaatatccgtaatgttgggaaattctagattattaacattcataatcaaggacatgagagccagacctcctgaagtttgataagatcctatagaagcctgctgaatggagctagtgatagatgacaaattactccgacgcaagccctcagcagcaaggatgcacaattggattagaaggaaaaccccaagaatttggtatctgctcaacaagacttaagggagttcagttactctgtgatagtaaaagtcaagagttgcaagtgtaaaagaagacaaaaaaatcattacctaggtctctgattcagttgctttcctatgaaaacataacgaaccccggatgcacgtttcgatatatgataataaaaacctgaaaagaaacaaaggttactagttcagaacatgctctacatgagttaaatatttctcacaaaattcaccttcaaagtagaagagcatcagattggcacgcaaaaccagttgtaagacttcgcgggcaacaggaagaacctaaaaggcacaaaaccttgtataaaacaacatttgctacgcagaaaacaagtgaacgaaccatggaaaattaaacgtgaggggtatacattaccacaggccatcgctgaatagctcggtgccacgatctcataagtctatcgtttaacctagatactacagaagttgaagtttcaacttgagatgaagatggaagatctatcattcttggtgagtggatatgactatcaccaaaaaactcatcagactcatcaaaggtgactgcttgcgtagcagctcgagtgctgtagacaattatatcaatatcagcggacaagattcaaatttttctttgtaaaacaacaataagaaatgcgacgaaacctaattctctctgcgatatatggaactgcggtctggtacaatatgaacaaagcacgtctagctggtgtaggagagagtccataaggccctgcaacctatattatatcattctacatcagaaggtaaaatggttttgtagaagcacacttaaggaagattgtataaagtaacaaaaacctgtataatgtcacaatattcctctcctaaagtttgttgccctgaacctgtcgtaagaacatagtaaagcatctgtccaagtagcttcatctatccaaaaacaataaaaacaaataatcaaaaatctcatggaaactcagacaaatataatttagtgtatattacctccttctggtaagcaagagcgattcttgtacctaagagtgataaaaattagttattaattggacaataacgatgaagcaattaaagtagacagttgttgttgtttggtttggtgtcggaaaaattgtaccgaaaaggtgtcggaaggcatcgcggcaagcttcgtggatgaaagaagcgtattgatcgtctttctcagcagctctcataatctccggctgagctgctaacgggaatcgtctgattccgccgtgaaacccgctcgaaccgggttcatcctgacccggacccgaatccccattaagcctcat

SEQ ID NO: 1846 - protein, 1029 aa, Arabidopsis thaliana
  G1526 Amino Acid Sequence
MGTKVSDDLVSTVRSVVGSDYSDMDIIRALHMANHDPTAAINIIFDTPSFAKPDVATPTPSGSNGGKRVDSGLKGCTFGDSGSVGANHRVEEENESVNGGGEESVSGNEWWFVGCSELAGLSTCKGRKLKSGDELVFTFPHSKGLKPETTPGKRGFGRGRPALRGASDIVRFSTKDSGEIGRIPNEWARCLLPLVRDKKIRIEGSCKSAPEALSIMDTILLSVSVYINSSMFQKHSATSFKTASNTAEESMFHPLPNLFRLLGLIPFKKAEFTPEDFYSKKRPLSSKDGSAIPTSLLQLNKVKNMNQDANGDENEQCISDGDLDNIVGVGDSSGLKEMETPHTLLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEGDERGLKLVQSILKPIMLRRTKSSTDREGRPILVLPPADARVIYCELSESERDFYDALFKRSKVKFDQFVEQGKVLHNYASILELLLRLRQCCDHPFLVMSRGDTAEYSDLNKLSKRFLSGKSSGLEREGKDVPSEAFVQEVVEELRKGEQGECPICLEALEDAVLTPCAHRLCRECLLASWRNSTSGLCPVCRNTVSKQELITAPTESRFQVDVEKNWVESSKITALLEELEGLRSSGSKSILFSQWTAFLDLLQIPLSRNNFSFVRLDGTLSQQQREKVLKEFSEDGSILVLLMSLKAGGVGINLTAASNAFVMDPWWNPAVEEQAVMRIHRIGQTKEVKIRRFIVKGTVEERMEAVQARKQRMISGALTDQEVRSARIEELKMLFT

SEQ ID NO: 1847 - DNA, 5498 bp, Arabidopsis thaliana
  G1526 Genomic Sequence
atgggaacgaaagtctcagacgatcttgtttccaccgtcagatcagtcgtgggttccgattactcagatatggatataatcagggctttacacatggcgaatcatgatccaacggctgctatcaatataatcttcgacactccaagtttcgccaaacctgatgtagccactcctaccccgagcggctctaatggagggaagcgagttgatagtggattaaagggctgtacttttggtgacagcggaagtgttggagcgaatcatcgcgtggaggaagaaaatgagagtgttaatggtggaggagaagagagtgtttcagggaatgagtggtggtttgttggttgttctgaattggctgggttatcgacatgtaaaggaaggaaattgaagtctggtgatgaattggtgttcacgtttccgcatagtaaaggattaaagcctgagactacgcctgggaagcgcggttttgggcggggaaggccagctttgcgtggtgcttctgatatcgttaggttctctacaaaggattcaggagaggtgtgtttcacatcttttttatttgctatgttaagtttgttagatgggaattgttaactaactatgatgggctcttgtggtagattggtagaataccaaacgagtgggctcggtgtcttctaccacttgtgagagacaagaaaattaggatagaaggcagttgcaagtcggcgcctgaagctttgagcatcatggatacaattcttctgtctgtaaggtatgcatacaaaacttttgtgttcccgtttacaatttcaggatagatgcattagtgtttgaagtggtgtgagtttgtttttgaaacagcgtgtacattaatagttccatgtttcaaaagcatagtgcgacttcatttaagacagctagtaatacggcagaggaatcaatgttccatcctctcccaaatctctttcggttactcggtttgatcccctttaagaaggtaatggttattccttgcctataacttgatatgcggattcttttatagattgcagtttgtagttcccatatacttctcatatgatgtgactgaataatcttgagatgacgaagaaatttttccattcttcatcatatttaggcagagtttactccagaggatttttactctaagaagcgacctttgagttccaaggtaaatattacttattatattagcatcttaaaatttgacttcttgcctgtaaaatttgtcatttgctctctgccctatggaaataggatggttctgctattcctacttcgttgcttcaattaaacaaggtcaagaatatgaatcaagatgcaaacggagatgaaaatgagcagtgtatcagcgatggtgatcttgataacattgttggtgttggggacagttctggattaaaggtattctcattttcaagacttcttgcttacttatatccaacactggaaatttcctttggaaaattgcatgaaaatttttgcaacaggaaatggaaactccacatacacttctgtgtgagcttcgtccataccaaaagcaggcacttcattggatgacccaactggagaaaggaaattgcactgatgaggcagcaacaatgcttcacccgtgttgggaagcatactgtttagcagacaagtgagtgatatttctattgccttcgaactttagtgcgagtcagataagatatttactatctgttttatgtcaataggagggaactggttgtctacctgaattcttttactggtgatgctacaatacacttccctagcacacttcaaatggcaagaggaggagtatgatctcaataccccacctataaaaatttctttcatttattgtttagattttgtcactttattatatagctgttttgtaataatattatatcctaaaacttttgtagatattagcagacgcaatgggtcttggaaagactgtaatgaccatatcccttttgcttgcccattcttggaaagctgcatcaactgggtttctatgccccaactatgaaggagacaaagtgatcagcagttctgtagatgatctcactagtcccccggtgaaggcaaccaaatttctaggctttgataagaggcttcttgaacaaaaaagtgtacttcaaaatggtggtaacctgattgtatgtccgatgacacttttaggacagtggaaggtattccatgcttaatgcacgtgcacactatagtttggttatccgtcaaagttgttaattgttctttgtctttccttgtgtcagctaatattttcttgctcctgctttatgatcagacagagattgaaatgcatgcaaagcctgggtctctatctgtctatgttcactatgggcaaagcaggccgaaggatgcaaaacttctttcccagagtgatgtggtaatcaccacatatggagttctaacatccgaattctcgcaagaggtatctttcatacaagagtcttcgggtcatggattattccatgtatatagtttataaaagcatcacatgaacattttcttatcttctctcgtttttcttcttcttagaactcagcagaccatgaaggaatttatgcagttcgatggtttaggattgttcttgacgaggcacataccatcaaaaactcaaaaagccaaatttccttggctgctgcagctctggttgctgataggcgttggtgtcttacgggtactcctattcaggtgattggtctttttgtctagggtttagaaagaaaatctttgttcttgaccgtcctatagaccaaactttattaggacactgccattctatctatggaagaattttagtagttggacatttgttattcacctgagtttcgaatggtctaaatctctgttagaaggatatcaacttgttgtgcatgatttattgtacacaagtctcgactttatctcacaaagttgtctttgaagatttatttcatatggcttgcaattttggtatccatatgtctgctggcatgatatcttggttcattcaaatggatggtgaatagtaattttttgtcctatttggaactttgtgatcatttcacatgttatcttattgacagaacaatctggaggatttatacagccttctacggtttttgaggattgaaccatggggaacttgggcatggtaagggtccttatctatctttggttggaaacacataacgtttggtatggaattacttgaagctttttaatttggaacatattttattcttaggtggaataaacttgtccaaaagccatttgaagagggtgatgagagagggttaaagctagtgcagtctatcttaaaacctatcatgcttaggagaacaaagtctagcacagaccgagaaggaaggtaggaatactacaaataatagattactgtataacttcctgtgcttataaaacataatattttcctttgagtttcctcggttaatttgaagcttgtttgtttattttaggccgattcttgttctaccccctgctgatgcacgggtcatttactgtgaactttcggagtctgagagggatttctacgacgcgctatttaaaagatccaaggtattgttttccttaggattatttactcgaactttagttattaagatgccttatactgaagatgctgacggatctttttcaggtcaaatttgatcaatttgttgaacaaggcaaagttcttcataactatgcttcgatcctggaactgcttttgcgtcttcgacaatgttgtgatcacccatttttagtaatgaggtgtggcttttactggctttttatttagtatagatacacattgctgggtttaacttccatggctacttaatctgttgcatgacgttgtataaaatatccaataacatatcgtagataatggcaatttggtataagaaacatgcatccgtagcccttgtttctgtttgacattttgttgacgcaattgccatatttcttataacagtctcttgtttttcttgcatccagtcgaggggatacagcggaatactctgatctgaataagctttctaaacgtttccttagtggaaagtcttctggcttagaaagggaaggaaaagatgtaccgtcagaggcttttgttcaggaggtggtagaggaactgcgcaaaggagagcaaggagagtgtccaatatgccttgaagcacttgaggatgctgtattaacgccatgtgctcatagattatgtcgtgagtgtctcttggcaagttggagaaattctacttctgggttatgtcctgtgtgtaggtatcttgaagttgttcctgcgattactagttttcttctgttgttgattccaatgagtgtctgagtaaggtctaatttggcaaataatgaatgatgaatcgtttttttcaggaacactgtaagcaaacaagaactcatcacagcaccaaccgaaagtagattccaggttgacgtggaaaagaattgggtggaatcatcgaaaatcactgctcttctggaagagcttgaaggtcttcgttcttcaggctctaagagcattctctttagccagtggaccgctttcctcgatctcctccaaattcccctctctcggtataccattgttggcttgctatggtagttatgagaataaattgtttttaagaatctaaattatagcacaattttatctccaggaataacttttcatttgtccgtcttgatggcacgctaagtcagcagcaacgagagaaggtccttaaagaattttccgaagatggcagtatcctggttggtgcagtcgcattacattgcaatgttcaatacttatactttctagtttcgaaattgaagttaaaaagtctccttttcaattgttggataggtactgttgatgtctctaaaagctggtggcgttgggataaatctaacagctgcgtccaatgcttttgtcatggtatggaatatctatagatatctatgaaagatcatatcagtttctataggatttagaccatgtaatagctcatccaaaatatgaaaatcgagtagtagttcatgccaccttttgtttcaaaagcttgtgaatgagtactgcacaatacaaaataggttttaaagaagtttcagttgtaaagaaaaccaagttatgtcctataggatccatggtggaacccagcggtagaggaacaagctgttatgcgtattcatcgtatagggcaaactaaggaagtcaaaatcagaagattcatcgttaaggtaccctcttctttctcagcagttagtccccattaaccatataaagaccaatcactgaaactattccaaaatcagaaaatgttgttgctgagtaatgatcattagaaacttgtatgtcttgcctttgtgaatcctagggaacggttgaagagagaatggaggcggttcaggcgaggaagcagagaatgatctctggggctttaaccgatcaagaagtacgaagtgcacgtatagaggaactcaagatgttatttacctga

SEQ ID NO: 1848 - DNA, 2169 bp, Arabidopsis thaliana
  G1526 DNA sequence used for BLAST
tcaggtaaataacatcttgagttcctctatacgtgcacttcgtacttcttgatcggttaaagccccagagatcattctctgcttcctcgcctgaaccgcctccattctctcttcaaccgttccctaggattcacaaaggcaagacatacaagtttctaatgatcattactcagcaacaacattttctgattttggaatagtttcagtgattggtctttatatggttaatggggactaactgctgagaaagaagagggtaccttaacgatgaatcttctgattttgacttccttagtttgccctatacgatgaatacgcataacagcttgttcctctaccgctgggttccaccatggatcctataggacataacttggttttctttacaactgaaacttctttaaaacctattttgtattgtgcagtactcattcacaagcttttgaaacaaaaggtggcatgaactactactcgattttcatattttggatgagctattacatggtctaaatcctatagaaactgatatgatctttcatagatatctatagatattccataccatgacaaaagcattggacgcagctgttagatttatcccaacgccaccagcttttagagacatcaacagtacctatccaacaattgaaaaggagactttttaacttcaatttcgaaactagaaagtataagtattgaacattgcaatgtaatgcgactgcaccaaccaggatactgccatcttcggaaaattctttaaggaccttctctcgttgctgctgacttagcgtgccatcaagacggacaaatgaaaagttattcctggagataaaattgtgctataatttagattcttaaaaacaatttattctcataactaccatagcaagccaacaatggtataccgagagaggggaatttggaggagatcgaggaaagcggtccactggctaaagagaatgctcttagagcctgaagaacgaagaccttcaagctcttccagaagagcagtgattttcgatgattccacccaattcttttccacgtcaacctggaatctactttcggttggtgctgtgatgagttcttgtttgcttacagtgttcctgaaaaaaacgattcatcattcattatttgccaaattagaccttactcagacactcattggaatcaacaacagaagaaaactagtaatcgcaggaacaacttcaagatacctacacacaggacataacccagaagtagaatttctccaacttgccaagagacactcacgacataatctatgagcacatggcgttaatacagcatcctcaagtgcttcaaggcatattggacactctccttgctctcctttgcgcagttcctctaccacctcctgaacaaaagcctctgacggtacatcttttccttccctttctaagccagaagactttccactaaggaaacgtttagaaagcttattcagatcagagtattccgctgtatcccctcgactggatgcaagaaaaacaagagactgttataagaaatatggcaattgcgtcaacaaaatgtcaaacagaaacaagggctacggatgcatgtttcttataccaaattgccattatctacgatatgttattggatattttatacaacgtcatgcaacagattaagtagccatggaagttaaacccagcaatgtgtatctatactaaataaaaagccagtaaaagccacacctcattactaaaaatgggtgatcacaacattgtcgaagacgcaaaagcagttccaggatcgaagcatagttatgaagaactttgccttgttcaacaaattgatcaaatttgacctgaaaaagatccgtcagcatcttcagtataaggcatcttaataactaaagttcgagtaaataatcctaaggaaaacaataccttggatcttttaaatagcgcgtcgtagaaatccctctcagactccgaaagttcacagtaaatgacccgtgcatcagcagggggtagaacaagaatcggcctaaaataaacaaacaagcttcaaattaaccgaggaaactcaaaggaaaatattatgttttataagcacaggaagttatacagtaatctattatttgtagtattcctaccttccttctcggtctgtgctagactttgttctcctaagcat

SEQ ID NO: 1849 - DNA, 1362 bp, Arabidopsis thaliana
  G1528 cDNA Sequence
atggaaaatgtggttgcaactgtgagtggttatcatggatccgataggtttaagctcatcaagcttatttctcattctggagcaagttatgttggggcaatgtcaagatctattacacatttggtgtgttggaaatttgagggcaaaaagtacgatcttgcaaagaagtttggtacagtagtagtgaatcatcgatgggtggaagaatgtgtaaaggaagggagaagagtttccgagacgccttatatgtttgatagtggagaagaggttggacctttgatgattgaactacctgcagtttctgaggaagctaaagtcactaagaaagtgaataaggcttctgaaacttttgataaatactttagtaatggtggagaaaaccggagtggctccacttctgagcttgccacttggatggagaaaaatgtagaagcaaacagacactcagtgcgattaagaacaaagaggccgagtagtattcttgaaaacaaggaaaacagtggtgtggcagaatcttcacggaaaggaaaaaagcgggtagtaaagcaacgctcttacagaaaccttatcgaccttgaatctgatgaggaatctgataataaccatcatgacaactctgatgagaaccaaaatgagactcaggatcatagagagcctgctgatgaaaatgtgaggggttttgttttcgaacaaggagaaacatcagctcttcgacatcctggagacttggcaacaccaaactgggatgtagatgaaatagaggagtctgagaattggagtcattcagctgtttttaaacgccctagatcatttagtccagagataaaaccacaagatgatgatgagtcaacaagagaagagacagaagcaactgagaaggctcctgcacaagtttcttgtatcatatgctggaccgagttcagttccagtagaggcattctcccttgcggccacaggttttgttattcatgcatccaaaaatgggcagaccgtttggtttcagaaagaaagaaaacaacatgtccactgtgcaagtccaatttcatcacaatcacaaagatagaagacgctgattcttccgatcaaaagatatactcacaaacagtccctgacttatcttcaacaaataacattcttgtagtactccctgaagaagaagaacaaagacaaactctcaatccactgactcgagcttcaggttgcagcagatgctacttgactgagccagaggagcttctgataagatgtcacctctgcaatttccggcgaatccactcctattgtttagacccttatctgcttccttggacctgtaaccattgcaatgatcttcagatgatgtaccaccgtcgcaactactaa

SEQ ID NO: 1850 - protein, 453 aa, Arabidopsis thaliana
  G1528 Amino Acid Sequence
MENVVATVSGYHGSDRFKLIKLISHSGASYVGAMSRSITHLVCWKFEGKKYDLAKKFGTVVVNHRWVEECVKEGRRVSETPYMFDSGEEVGPLMIELPAVSEEAKVTKKVNKASETFDKYFSNGGENRSGSTSELATWMEKNVEANRHSVRLRTKRPSSILENKENSGVAESSRKGKKRVVKQRSYRNLIDLESDEESDNNHHDNSDENQNETQDHREPADENVRGFVFEQGETSALRHPGDLATPNWDVDEIEESENWSHSAVFKRPRSFSPEIKPQDDDESTREETEATEKAPAQVSCIICWTEFSSSRGILPCGHRFCYSCIQKWADRLVSERKKTTCPLCKSNFITITKIEDADSSDQKIYSQTVPDLSSTNNILVVLPEEEEQRQTLNPLTRASGCSRCYLTEPEELLIRCHLCNFRRIHSYCLDPYLLPWTCNHCNDLQMMYHRRNY

SEQ ID NO: 1851 - DNA, 2069 bp, Arabidopsis thaliana
  G1528 DNA sequence used for BLAST
atggaaaatgtggttgcaactgtgagtggttatcatggatccgataggtttaagctcatcaagcttatttctcattctggagcaagttatgttggggcaatgtcaagatctattacacatttggtttgtgtagattgttctgttctgtttatgtgattcattaccactgtggagaaatgaagacatacccttttgtttaattggttatgtgtgtaggtgtgttggaaatttgagggcaaaaagtacgatcttgcaaagaagtttggtacagtagtagtgaatcatcgatgggtggaagaatgtgtaaaggaagggagaagagtttccgagacgccttatatgtttgataggtatgcttattggtttccggtccttatagcttctatgttcctcaaagatgattgataaagccttaatttttcagtggagaagaggttggacctttgatgattgaactacctgcagtttctgaggaagctaaagtcactaagaaagtgaataaggcttctgaaacttttgataaatactttagtaatggtggagaaaaccggagtggctccacttctgagcttgccacttggatggaggtaatcctcgttctcttattacctatttgcttagatagtagatacaagccgcatctaggtttctacagctattagtttagtttttattgaatttcagtaatagaacaaatgttttgtgttgtatacttctatatccaaaagatcagaagagaattatctttttgcatagtatatctagtatcatttgaaagaccgatgtgctgatagcatatcctcatcagatttcatagctaccaagattagctttgcgtagccactgtggaaagtaacatgttaattagtgtgaatgtaattgcttacttgcatgactgttatgtgtatggtatacttagtttgttttcttcatgtctctgggcttctttgttgctcttcagaaaaatgtagaagcaaacagacactcagtgcgattaagaacaaagaggccgagtagtattcttgaaaacaaggaaaacagtggtgtggcagaatcttcacggaaaggaaaaaagcgggtagtaaagcaacgctcttacagaaaccttatcgaccttgaatctgatgaggaatctgataataaccatcatgacaactctgatgagaaccaaaatgagactcaggatcatagagagcctgctgatgaaaatgtgaggggttttgttttcgaacaaggagaaacatcagctcttcgacatcctggagacttggcaacaccaaactgggatgtagatgaaatagaggagtctgagaattggagtcattcagctgtttttaaacgccctagatcatttagtccagagataaaaccacaagatgatgatgagtcaacaagagaagagacagaagcaactgagaaggctcctgcacaagtttcttgtatcatatgctggaccgagttcagttccagtagaggcattctcccttgcggccacaggttttgttattcatgcatccaaaaatgggcagaccgtttggtgagtttatcttccttgcttttcaaactaattctcataaaatccatattggtaaatgatgcaacttccttattatatctgcaggtttcagaaagaaagaaaacaacatgtccactgtgcaagtccaatttcatcacaatcacaaagatagaagacgctgattcttccgatcaaaagatatactcacaaacagtccctgacttatcttcaacaaataacattcttgtagtactccctgaagaagaagaacaaagacaaactctcaatccactggtaagccgagagtattgagctactacgcgatcttgttcttgatagcaacaacattctattgtgttttgtttttttctcctgcagactcgagcttcaggttgcagcagatgctacttgactgagccagaggagcttctgataagatgtcacctctgcaatttccggcgaatccactcctattgtttagacccttatctgcttccttggacctgtaaccattgcaatgatcttcagatgatgtaccaccgtcgcaactact

SEQ ID NO: 1852 - DNA, 783 bp, Arabidopsis thaliana
  G1537 cDNA Sequence
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 1853 - protein, 260 aa, Arabidopsis thaliana
  G1537 Amino Acid Sequence
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 1854 - DNA, 1220 bp, Arabidopsis thaliana
  G1537 Genomic Sequence
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacggcacgtagttcttatccttttctcttacttatccgtatctaatcttcgacgttctattttataatcttaaaaaaattgtagtccatacgttataggttctttttgttgacgacgttttctttccgtattaaagaaatgaaaataaagcgtatgaattacatctggactatgaaagaacttacaaaaacatgtcattaaatacatatataaatatataatccagttttggccatttatcgctgagattcaaatttgttttttaaaattttaacataaaaacatataatcggatgcgaaaggattatatcatatgggactattttgagatgtttatcagcaaattatgtactctggattagcaggttttatgtttgttttttcatttttatcaatataattgggtattactaaataaaatcttttttttggttatgaagtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 1855 - DNA, 1218 bp, Arabidopsis thaliana
  G1537 DNA sequence used for BLAST
acaacccattaccattactatcgaaacgagtagaagtagaaccaccagaaaagaaatcaataaacggctgctctcggccggctccatcgctagaacaatccaccggagaatcactaccaagggcaaaactggaacttcccataccatcagcattacttgcattcaaaggctgaagaggaaaaagagggagtgttttccgtccactggaattgacgttaatgtcctcaccggcataacagttatcacggagggcaaatctgtcaaatctgagtgaactcggagaaattggcattcttgtggctgctgttgttcttatgtctgaaagttgtttctgatgttgtgtgactgtccgtttctcgtagccaccacttggaatcatcacattgtttctgtgaagaagatcgtttgtgtatacacttccatgttgattcatatgatgatcacttgcttgctgtaaatagtacggactgacacaacccacttcataaccaaaaaaaagattttatttagtaatacccaattatattgataaaaatgaaaaaacaaacataaaacctgctaatccagagtacataatttgctgataaacatctcaaaatagtcccatatgatataatcctttcgcatccgattatatgtttttatgttaaaattttaaaaaacaaatttgaatctcagcgataaatggccaaaactggattatatatttatatatgtatttaatgacatgtttttgtaagttctttcatagtccagatgtaattcatacgctttattttcatttctttaatacggaaagaaaacgtcgtcaacaaaaagaacctataacgtatggactacaatttttttaagattataaaatagaacgtcgaagattagatacggataagtaagagaaaaggataagaactacgtgccgtttgagcaaggaggggggtagaagaaacgggaggttttgtggaggaggcgattgaagtaagccatgcgctcctgtttctgcttttggcgttgcctagccttatggttctggaaccagtaaaagacgtttttaccttcgatatggccgtacgcacgaagcctaccggtgatctgctgaatctgatcggcgctcggagttcgtattccttccttgtaaagattttccagtagcgtgatctgatctttcgttgggttccatcttgaactgcttgctgttcctgcgtttacttcgttttccat

SEQ ID NO: 1856 - DNA, 462 bp, Arabidopsis thaliana
  G1538 cDNA Sequence
atggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataa

SEQ ID NO: 1857 - protein, 153 aa, Arabidopsis thaliana
  G1538 Amino Acid Sequence
MDHGRLMDDQMMLGSQVYPYTTQPQNSHCIIVNQIDGGEESKPVKRRRKRRSKGSSATNEEDVAEIGGMLRKRKLTDEQVNMLEYSFGNEHKLESGRKEKIAGELGLDPRQVAVWFQNRRARWKNKKLEEEYAKLKNHHDNVVLGQCQLESQV

SEQ ID NO: 1858 - DNA, 462 bp, Arabidopsis thaliana; identical to SEQ ID NO: 1856
  G1538 Genomic Sequence

SEQ ID NO: 1859 - DNA, 462 bp, Arabidopsis thaliana; identical to SEQ ID NO: 1856
  G1538 DNA sequence used for BLAST

SEQ ID NO: 1860 - DNA, 1227 bp, Arabidopsis thaliana
  G1540 cDNA Sequence
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 1861 - protein, 291 aa, Arabidopsis thaliana
  G1540 Amino Acid Sequence
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 1862 - DNA, 1572 bp, Arabidopsis thaliana
  G1540 Genomic Sequence
atggagccgccacagcatcagcatcatcatcatcaagccgaccaagaaagcggcaacaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacggtgactaatctctcttatacatgcttttttatgaatttattcaggtggttttttataattactaagagaaccatttacaccactagctattacatgaattagcacacacaaaaaaaaaaaaactaacaagatctacatatatgactttgatagatatatgtatatgttaattgttaaaaagattttaaaaaatgctgttgatttatgaatttattcagatggttttgatttaaaaatctaaaatatatattataggaacatgttacacaccatctattattacatgaattagtaaaaataattaaacccaagaagatgttatgtacatgtaatgacgtatatttgaagttatggatcttgattggggcaaaccaaatttgcatctaaagaacggtttctttgttgtgtaatggaaactagactcacgtgcattttattttcatttgtgacttgtaacacaattagggatttgggttagtagaaaaaaaatcactaattttatgtctctttcttcattcttttcccctgtatatagtatggtctggattctggaatcacaacatatatgatcactgatgatacgtatattaatatgtttgaagggaatttaaatcatgcaagctcaggtactgaatgtggtgttgttaatgcttctaatggctacatgagtagccatgtctatggatctatggtacgtaccaaactataattcattaattcaaataatatttatactacatatatgaatagaaatttaatgaaactgaaatttttgggtgaaggaacaagactgttctatgaattacaacaacgtaggtggaggatgggcaaacatggatcatcattactcatctgcaccttacaacttcttcgatagagcaaagcctctgtttggtctagaaggtcatcaagaagaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactag

SEQ ID NO: 1863 - DNA, 1572 bp, Arabidopsis thaliana
  G1540 DNA sequence used for BLAST
ctagttcagacgtagctcaagagaagcgcaagggcgaacttccgattggccatacttccagatggcaccactaccaccgttgatgtgatcttcaccgtgcatagggaagagaggaagcgtacgtcgatgttccagataagcatcgccaccacattcttcttcttcttgatgaccttctagaccaaacagaggctttgctctatcgaagaagttgtaaggtgcagatgagtaatgatgatccatgtttgcccatcctccacctacgttgttgtaattcatagaacagtcttgttccttcacccaaaaatttcagtttcattaaatttctattcatatatgtagtataaatattatttgaattaatgaattatagtttggtacgtaccatagatccatagacatggctactcatgtagccattagaagcattaacaacaccacattcagtacctgagcttgcatgatttaaattcccttcaaacatattaatatacgtatcatcagtgatcatatatgttgtgattccagaatccagaccatactatatacaggggaaaagaatgaagaaagagacataaaattagtgattttttttctactaacccaaatccctaattgtgttacaagtcacaaatgaaaataaaatgcacgtgagtctagtttccattacacaacaaagaaaccgttctttagatgcaaatttggtttgccccaatcaagatccataacttcaaatatacgtcattacatgtacataacatcttcttgggtttaattatttttactaattcatgtaataatagatggtgtgtaacatgttcctataatatatattttagatttttaaatcaaaaccatctgaataaattcataaatcaacagcattttttaaaatctttttaacaattaacatatacatatatctatcaaagtcatatatgtagatcttgttagtttttttttttttgtgtgtgctaattcatgtaatagctagtggtgtaaatggttctcttagtaattataaaaaaccacctgaataaattcataaaaaagcatgtataagagagattagtcaccgttattgaagctgggatatggcttgttatgatgatagagatgatggtcttggttaagtttaacgttgacggaattagcaggtctctgcatgggaacaccgtgatgatggtgaagtagaggatgataatgatcgttagccgccatcataaccgagttgggtgatgaagatggtgtggtcatgtttgttccgttgaatctcttcttctgacgctcacgagccttatggttctggaaccagtaaaagacgttcttgccctcaatctttccgaactgtctcagccttgcagtgatcttctggatctgatcggctgttggtgaccggattgcattgttgtagtaaagttctttgaggattttgatttgctccgtcgtcggtgtccacctcgtgctggtctggcgacacgtgtaaccaccagagccggacttgttgttgttgttgttgccgctttcttggtcggcttgatgatgatgatgctgatgctgtggcggctccat

SEQ ID NO: 1864 - DNA, 1627 bp, Arabidopsis thaliana
  G1541 cDNA Sequence
cgtcgacgggagctgattaggttttgttccttcaatctctgggaattttcgctatgcactcagattcaggcgaagcgaccgctgatggcgataaagcttctacagaaaacagcaaaaaacggaagcttaagactcctatgcaagttatggcgcttgagaatttctacaatgagcataagtatccgactgaagaaatgaagggcaagttagcagaggaagttggattaactgagaagcaagtttcaggttggttctgccatagaaggttaaaagacaaacgtcatgtaaaagaagatgggaatgccattgggagccaagatcggtcaagcgttgttcttcaggatcgtggaagtgggcttcgacaggattcatgtggtagtacaaagcaaacggattattggaaccccaagcctagggaagttgaaagtcaaaggctttatatgggaaatgctgatggtgaagatagtacatcttctgatcgtagctcatcattacgtaagaatcttgtctctagcaaagatggaattcgcgatgtggaaagttctagatatgttgcacataaagacgttattcagcatcctcagttcatgagaagctatgggtataataagccttcgggatacttgaaagtgaagggagagagtgagaattttgctatcactgccgtaaagagacaattaggaagacaataccaagaggatggtccacctctgggggttgaatttgatcctcttcctcccggtgcatttgagcctcagactaatcctatagttcacgagccaatatatgttgggaatcagagacggcctcaccttccacatttacttggaacgaggaagagctttaatcctggtcctagctatgaattagctcgtaaatcaaagttgcattcgccagatccagattcagaggatgatgagcatgatgatgatgacaacataatggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggcaggaatatatcacggggagaggaatcaaatgaaaatgcagagagagaaattgcattcgactgatgaaccaccggttgccaaacgagtgaaacatgggtatattcagcaagtatatgcaccaaaatcatcatcatacagcgagattcttgaacgaaaaagccagataaatcggtctggtgtggaactgccttctagtttaagcggggacgatgagactgacgaatctagctcgtcaatggattaagtaaagaaaggtacaaaggaagattaggaaattccgggcggccgctctag

SEQ ID NO: 1865 - protein, 507 aa, Arabidopsis thaliana
  G1541 Amino Acid Sequence
MHSDSGEATADGDKASTENSKKRKLKTPMQVMALENFYNEHKYPTEEMKGKLAEEVGLTEKQVSGWFCHRRLKDKRHVKEDGNAIGSQDRSSVVLQDRGSGLRQDSCGSTKQTDYWNPKPREVESQRLYMGNADGEDSTSSDRSSSLRKNLVSSKDGIRDVESSRYVAHKDVIQHPQFMRSYGYNKPSGYLKVKGESENFAITAVKRQLGRQYQEDGPPLGVEFDPLPPGAFEPQTNPIVHEPIYVGNQRRPHLPHLLGTRKSFNPGPSYELARKSKLHSPDPDSEDDEHDDDDNIMVGMEPGLRDKKSFGEPRLKSPSTSFYNSVPRHKSFKETFKGSPREIPVTNSKKGWISSKSWAEGSRNHLVANVQNLSGSNIETNQSHDYDNNISNGGRKTGYLTKSSKLLPPSRSRSPESMDRGPSSGMAGIYHGERNQMKMQREKLHSTDEPPVAKRVKHGYIQQVYAPKSSSYSEILERKSQINRSGVELPSSLSGDDETDESSSSMD

SEQ ID NO: 1866 - DNA, 2695 bp, Arabidopsis thaliana
  G1541 Genomic Sequence
atgcactcaggtgaaattcgttttttcctctatttcaatctctgtcttcctgcgagtttacgtgagagaatagtttttaatgatcccgagttcgtcgaattacaatgcaactcccagtttttgtagttttaattagcgaaattcatcaatggcattggaaattttaagccttttttggtttgttttatggtactactaattattcaagctaaggaattccaaagttttcgttcgttttgattgggtttagaagtatttggctgatgagagaaagagccataattctgaaattaaacccttttatgtgaagcttgtgtagatgttttacctgaatttcggaattactagcaacatttctaaatacacaaagcatgattgtaaaatgaaattgattttggtcagggctttgcatctcttggttattgaatggtgtccgtgtttcactattatcttcttatgtttttgatttttatgtgctattttcgatagattcaggcgaagcgaccgctgatggcgataaagcttctacagaaaacagcaaaaaacggaagcttaagactcctatgcaagttatggcgcttgagaatttctacaatggtaaattatggctttgttgtttgcatatgttcctttataccaagttgtatatgctttacaggtgtgatttggtttttctacagagcataagtatccgactgaagaaatgaagggcaagttagcagaggaagttggattaactgagaagcaagtttcaggttggttctgccatagaaggttaaaagacaaacgtcatgtaaaagaagatgggaatgccattgggagccaagatcggtcaagcgttgttcttcaggatcgtggaagtgggcttcgacaggattcatgtggtagtacaaagcaaacggattattggaaccccaagcctagggaagttgaaagtcaaaggctttatatgggaaatgctgatggtgaagatagtacatcttctgatcgtagctcatcattacgtaagaatcttgtctctagcaaagatggaattcgcgatgtggaaagttctagatatgttgcacataaagacgttattcagcatcctcagttcatgagaagctatgggtataataagccttcgggatacttgaaagtgaagggagagagtgagaattttgctatcactgccgtaaagagacaattaggaagacaataccaagaggatggtccacctctgggggttgaatttgatcctcttcctcccggtgcatttgagcctcagactaatcctatagttcacggtgagtcatgataaaatgtttcaactttacctttaattttctggtttatgatgttatgagtattgagtaagtggctcagagaagctaaaaccatcttcttcgtgtgtcagattgtgaatgcctttacccatgtccagtcggatttgattgctttttctatcaactgttttgtcagagccaatatatgttgggaatcagagacggcctcaccttccacatttacttggaacgaggaagagctttaatcctggtcctgtaagtgaacattttctgtatactacatacccatgaagataatataaactagaatcttagtctgccatcacattctttggctaaattatcttactttctttgaagtattattaatattttcgttttctgtcttaatgtctttatagagctatgaattagctcgtaaatcaaagttgcattcgccagatccagattcagaggatgatgagcatgatgatgatgacaacataatggttggaatggagcctggtctaagagataagaaaagttttggggaaccaagactgaaatccccttctaccagtttctataattctgtacctcgccacaaatcgtttaaagagacattcaaaggttcaccacgggaaatccctgtaactaacagcaagaagggttggataagttccaaaagttgggctgaagggtcgagaaaccatctggttgccaacgtccaaaatctttctggaagcaatattgaaaccaatcagtctcatgattatgataataatatatctaatggcggacgcaagacgggatatctcactaaatcttcgaagctgttacctccgagtagaagcagatcccctgagtcaatggatagaggtccatcttctgggatggtaaagatttgtctaatacttccatgtctacatgttcctttcttgcccttttatggaaatatgacttgtgttttgtgtgatatcttcttttaaaggcaggaatatatcacggggagaggaatcaaatgaaaatgcagagagagaaattgcattcgactgatgaaccaccggtgagtttgatggttaactatcttaaaaatatagatattgatgtatattttaacaaagtttagaggctctatcaagttcgtgttctgacctttaacgaatgttaataggttgccaaacgagtgaaacatgggtatattcagcaagtatatgcaccaaaatcatcatcatacagcgagattcttgaacgaaaaagccagataaatcggttagtaaccaaccattgtgtaatgcatttattgtcccaaagagatatcaaatcggcttattggatcatactgttatgtttgtaggtctggtgtggaactgccttctagtttaagcggggacgatgagactgacgaatctagctcgtcaatggattaa

SEQ ID NO: 1867 - DNA, 2695 bp, Arabidopsis thaliana; identical to SEQ ID NO: 1866
  G1541 DNA sequence used for BLAST

SEQ ID NO: 1868 - DNA, 768 bp, Arabidopsis thaliana
  G1542 cDNA Sequence
atgtcttgtaataataatggcttagctttcttccctgaaaatttcagtctccaaaaccatcaccaagaagaagaagatcaccctcaacttcttcaagacttccatgggtttctaggtaaaagatctccaatgaacaacgtgcaagggttttgtaatctagatatgaacggagatgaagaatattcagacgatggatctaagatgggagagaagaagaggagattgaacatggaacaattgaaggcactagagaaggactttgagcttggtaataaacttgaatcagatcgaaaattagagctagctcgtgccttgggattgcaacctagacaaattgctatatggttccaaaacagaagagctcgatccaaaaccaagcagcttgagaaagactatgacatgcttaagcgtcaattcgaaagtctcagagatgagaacgaagttcttcaaactcaaaatcaaaagcttcaagctcaggtaatggcattgaaaagcagagaaccaatagaatcaatcaatctgaacaaagaaacagaaggatcatgtagtgacagaagtgagaacatttctggtgacatcaggccaccggagatcgatagccaattcgccctaggccatccaccgacaactacaacgatgcagttttttcagaattcatcgtcagaacagagaatggtgaaagaagagaacagtatcagtaacatgttctgtggaattgatgaccagtctgggttctggccatggcttgaccagcaacaatacaattga

SEQ ID NO: 1869 - protein, 255 aa, Arabidopsis thaliana
  G1542 Amino Acid Sequence
MSCNNNGLAFFPENFSLQNHHQEEEDHPQLLQDFHGFLGKRSPMNNVQGFCNLDMNGDEEYSDDGSKMGEKKRRLNMEQLKALEKDFELGNKLESDRKLELARALGLQPRQIAIWFQNRRARSKTKQLEKDYDMLKRQFESLRDENEVLQTQNQKLQAQVMALKSREPIESINLNKETEGSCSDRSENISGDIRPPEIDSQFALGHPPTTTTMQFFQNSSSEQRMVKEENSISNMFCGIDDQSGFWPWLDQQQYN

SEQ ID NO: 1870 - DNA, 1114 bp, Arabidopsis thaliana
  G1542 Genomic Sequence
atgtcttgtaataataatggcttagctttcttccctgaaaatttcagtctccaaaaccatcaccaagaagaagaagatcaccctcaacttcttcaagacttccatggtacatcatctcaattaacacctttgttcaaaatttctaatcctttttttttctacttctcaagatcttctctgtttttagggtttctaggtaaaagatctccaatgaacaacgtgcaagggttttgtaatctagatatgaacggagatgaagaatattcagacgatggatctaagatgggagagaagaagaggagattgaacatggaacaattgaaggcactagagaaggactttgagcttggtaataaacttgaatcagatcgaaaattagagctagctcgtgccttgggattgcaacctagacaaattgctatatggttccaaaacagaagagctcgatccaaaaccaagcagcttgagaaagactatgacatgcttaagcgtcaattcgaaagtctcagagatgagaacgaagttcttcaaactcaaaatcaaaagcttcaagctcaggtaaaagcagaaacttcataacacaaaagtactctgtttcttttttaatcttaaatactctgttttttaaatcatatatttcataaaatatgaatcttttttagttgaattttataaaaacaatgctcttttttgttttttattgatgttattctttcagtttcgaattcataatttggaatatatttgttttaggtcaaaacataatttggaatcattttgcaattttacgttctttcttaaatagtttgtgtaaattatgcaggtaatggcattgaaaagcagagaaccaatagaatcaatcaatctgaacaaagaaacagaaggatcatgtagtgacagaagtgagaacatttctggtgacatcaggccaccggagatcgatagccaattcgccctaggccatccaccgacaactacaacgatgcagttttttcagaattcatcgtcagaacagagaatggtgaaagaagagaacagtatcagtaacatgttctgtggaattgatgaccagtctgggttctggccatggcttgaccagcaacaatacaattga

SEQ ID NO: 1871 - DNA, 1114 bp, Arabidopsis thaliana; identical to SEQ ID NO: 1870
  G1542 DNA sequence used for BLAST

SEQ ID NO: 1872 - DNA, 828 bp, Arabidopsis thaliana
  G1543 cDNA Sequence
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 1873 - protein, 275 aa, Arabidopsis thaliana
  G1543 Amino Acid Sequence
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 1874 - DNA, 2572 bp, Arabidopsis thaliana
  G1543 Genomic Sequence
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccggtaagctttacacaagacacatatatacatgcttcaatatgattaaagaaactactatatgaaccaaccaagtatatatttatgatgaggcttgtgtttggattctatgtttcttttggtggatgatctgattatcttatttcgtttttacaaacaaaatctctaaacagatattgacaatcataaaaatataattagttttttcatcgtcttttttctttatgatcacatattttttcattttgtccttgtgaatataatttatacacgcaataagtttcagatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccgtaatttattattcacaataaaacataactacttctgctgtttttatatcttttaattttagaacaaaaagaattgtattgaatgttaatctattttgttttttattttgtgaaacatagaaacaaaaggaagtacttgccaagcatttgatgctacggccaagacaaattgaagtttggtttcaaaaccgtagagcaaggtacggttttattttcctctttgtttctttcttaagagacttttgttttcttacatcattggtgggtggttgatgattaacgagagagttcacaaaaatataagcgttaaacgttgacggaatataaaaataaagcagaaaaaatgaaatctgaatcggattcgacccaccccgttaacgtgtatatataagtcgtacccttaaataataaaaagctaatcttgtcctaaatcaaatatttgttttataatgttttccttctaggtccttcttaaattcttgaagagtcaccacttgtttagttgttacacatagagaaggaaaatgtcaattcctaaatttttgaagtcaaagaaattacggaaagagattaattaacagccacacgtattaataaaagtaatatgttaatgttgaagtagttatatatatcaacatcacgtacatatgtgttgttgcatggttactttcaaaagtgacaacagcattttggagccgccaattgtgatatccattacatgtttaatgtgtgatgtaacttggagcaagttttacaaaacactttggcccgtgtacgtcaatacgtgtatacattatttcatttacctaaatattcacgtgtcaatgcatatgtctcaatgtttcatgaactcattacgcatcagtcgttttattacaatttcccggtaacgtatataggttatatgtctttagtttctgcatgaatatatattgttcatgtgtaaacacacatattagtaatcaatctatataatccgatagtcattgttattcaaactgaaaattggttagattgtcttttcttttttagactcaatataaaaatagttcctttatctagatcccacaataattgtgagcagatgggaaaggtatggtgcaataaataagaagaatttcaacattggtcgtataactattatgacggtttcccaaattataactataagtctataatcataaccacacccttttttataatagaagtattttaaagccttttttcgttttgaattttttatatgtttgattttttattttttaataaatttttaagtaaatcaatcaacgtgttttcttttttgtgcctcgtgtacttgctttctcatcaatgccctttgactcataattcattgggcagttcatgcgtttttaattccatgattttttatatttgcatcgtcacctagcatttgatcattgcttgcatgttataatttacaagttgtacaaaaacatctatgagtttaatgtgtttacgcgcgtacatgtcaaaaaataacgtatcgtactgtacgtttttggatttgtttggattaggagcaaattgaagcaaaccgagatggaatgcgagtatctcaaaaggtggtttggttcattaacggaagaaaaccacaggctccatagagaagtagaagagcttagagccatgaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 1875 - DNA, 2572 bp, Arabidopsis thaliana
  G1543 DNA sequence used for BLAST
tcaacgatcacgctcttgcggcggaaacgttttcttagccggaaccggcaccaccgccctcgaagggctcgcggcaggggtaactcgctcgcagcgaggacacatagtaaggctcgaggcagagttcaccgttgttgggccaaccttcatggctctaagctcttctacttctctatggagcctgtggttttcttccgttaatgaaccaaaccaccttttgagatactcgcattccatctcggtttgcttcaatttgctcctaatccaaacaaatccaaaaacgtacagtacgatacgttattttttgacatgtacgcgcgtaaacacattaaactcatagatgtttttgtacaacttgtaaattataacatgcaagcaatgatcaaatgctaggtgacgatgcaaatataaaaaatcatggaattaaaaacgcatgaactgcccaatgaattatgagtcaaagggcattgatgagaaagcaagtacacgaggcacaaaaaagaaaacacgttgattgatttacttaaaaatttattaaaaaataaaaaatcaaacatataaaaaattcaaaacgaaaaaaggctttaaaatacttctattataaaaaagggtgtggttatgattatagacttatagttataatttgggaaaccgtcataatagttatacgaccaatgttgaaattcttcttatttattgcaccatacctttcccatctgctcacaattattgtgggatctagataaaggaactatttttatattgagtctaaaaaagaaaagacaatctaaccaattttcagtttgaataacaatgactatcggattatatagattgattactaatatgtgtgtttacacatgaacaatatatattcatgcagaaactaaagacatataacctatatacgttaccgggaaattgtaataaaacgactgatgcgtaatgagttcatgaaacattgagacatatgcattgacacgtgaatatttaggtaaatgaaataatgtatacacgtattgacgtacacgggccaaagtgttttgtaaaacttgctccaagttacatcacacattaaacatgtaatggatatcacaattggcggctccaaaatgctgttgtcacttttgaaagtaaccatgcaacaacacatatgtacgtgatgttgatatatataactacttcaacattaacatattacttttattaatacgtgtggctgttaattaatctctttccgtaatttctttgacttcaaaaatttaggaattgacattttccttctctatgtgtaacaactaaacaagtggtgactcttcaagaatttaagaaggacctagaaggaaaacattataaaacaaatatttgatttaggacaagattagctttttattatttaagggtacgacttatatatacacgttaacggggtgggtcgaatccgattcagatttcattttttctgctttatttttatattccgtcaacgtttaacgcttatatttttgtgaactctctcgttaatcatcaaccacccaccaatgatgtaagaaaacaaaagtctcttaagaaagaaacaaagaggaaaataaaaccgtaccttgctctacggttttgaaaccaaacttcaatttgtcttggccgtagcatcaaatgcttggcaagtacttccttttgtttctatgtttcacaaaataaaaaacaaaatagattaacattcaatacaattctttttgttctaaaattaaaagatataaaaacagcagaagtagttatgttttattgtgaataataaattacgggattaagggtatgattctgtctgaaactatcttcaagaagacgtgactgttctctggttagacggagtttctttcgcggaggagcagagccatcatcgtgactgaattcttcatcgtctccgtcttcagacgacggtaaccgattcatgtctagccttagctggtctcttcctccgccacttccttcatctgaaacttattgcgtgtataaattatattcacaaggacaaaatgaaaaaatatgtgatcataaagaaaaaagacgatgaaaaaactaattatatttttatgattgtcaatatctgtttagagattttgtttgtaaaaacgaaataagataatcagatcatccaccaaaagaaacatagaatccaaacacaagcctcatcataaatatatacttggttggttcatatagtagtttctttaatcatattgaagcatgtatatatgtgtcttgtgtaaagcttaccggagagaggggatgaagagaagcctggaacggagatagtaagatccaagtttgaagagttttccggcaaaatcgccattattttgatcaatgaattattagggttcttaagagctaggatcgaagaagaaaaggtaaagtttgagaggaaaactctcagtttaatataaaagagacaaacttgaagcgtgacgatgcctttatatttatacatacacacgcatgcgtaatccatatgatatagagcatatagtttatatgtgtatgtgcatatgtacgtaaatagtagttttatcat

SEQ ID NO: 1876 - DNA, 1599 bp, Arabidopsis thaliana
  G1550 cDNA Sequence
atggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatgagcgcgatggcaggtgccacggggattcttcagaccggtcagggactgtcccttagccttggttcacagattcttccaggaattcatcagataagccatcaaaatatggcgccgagaggcaatgagtatgcaacacagagttttccgggcgggaatcagaacttggatgttgtgagaacaattcccaactcaaagtatcttaaggcggctcaacagcttctagatgaggctgttaatgtaaagaaagctctaaagcagtttcaggcagagggagataaaaacaatgagaaccctcaagaaccgaatcagagcactcaagactcgagcacgaatcctcctgcggacatctctcagtcggagagacaagaaatgcagagcaagttgacaaaactcttgtcaatgttggatgaggtggatagaagatataagcaatattaccagcagatgcagatagttgtatcctcgttcgatgtgatagctggttatggagcagctaagccatacacagcactcgcccttcaaacaatttctcgccattttcgtagcctaagggatgcgatatccggacaaatcctcgtgctacgtaaatgccttggggaacaacaagatggatcagatgggaaaagagttgggattataagccggcttaagtacgttgatcaacatttaagacaacaaagaggttttatgcaacctcaagcttggagacctcaacgcggtctacctgaaaactctgttttgattctccgtgcttggctctttgagcattttcttcacccttacccaaaggattctgataagatcatgctagcaagacaaacgggcttgagccgcggtcaggtttcaaactggttcataaatgcacgagtgcgtttatggaagccaatggtggaggagatatacaaggaggaattcacagagaatgattccaactcgtcttccgaaaatacaccgaaaatgtctgagataggacctgttgctgctgatgatgaagatcgagctcgagagttttcacaagaccagaccaaaccggaccatggacatggatatggcgaggaaactcgtggcatggtccaaggcagtcatatggatggtcgccggttcatggcagttgagcctacatatcatgtggctgatacgtcaagattgggtcgtggtgatgtgtccttgactctagggcttcaaaactctcaaggacaggacaatgttgtggctatgtctagtgaggcatacaacaacttttccggggtggatatttacgagaatgccatcccgggagatgaaatggagtatgtaaaccccggaagtcgccagaaccggataaattcttcacaattggtacatgattttgtagcttga

SEQ ID NO: 1877 - protein, 532 aa, Arabidopsis thaliana
  G1550 Amino Acid Sequence
MENYPETQFIPGDSMIQNAIVSYSEESAGRERRTEANNVSASQERQALSRFGGVPQMQNIGQDFGSWRDQASDRNGFQLMSAMAGATGILQTGQGLSLSLGSQILPGIHQISHQNMAPRGNEYATQSFPGGNQNLDVVRTIPNSKYLKAAQQLLDEAVNVKKALKQFQAEGDKNNENPQEPNQSTQDSSTNPPADISQSERQEMQSKLTKLLSMLDEVDRRYKQYYQQMQIVVSSFDVIAGYGAAKPYTALALQTISRHFRSLRDAISGQILVLRKCLGEQQDGSDGKRVGIISRLKYVDQHLRQQRGFMQPQAWRPQRGLPENSVLILRAWLFEHFLHPYPKDSDKIMLARQTGLSRGQVSNWFINARVRLWKPMVEEIYKEEFTENDSNSSSENTPKMSEIGPVAADDEDRAREFSQDQTKPDHGHGYGEETRGMVQGSHMDGRRFMAVEPTYHVADTSRLGRGDVSLTLGLQNSQGQDNVVAMSSEAYNNFSGVDIYENAIPGDEMEYVNPGSRQNRINSSQLVHDFVA

SEQ ID NO: 1878 - DNA, 1953 bp, Arabidopsis thaliana
  G1550 Genomic Sequence
atggagaattatccagaaacacagtttattcccggagattcaatgatccagaatgctatagtttcttactctgaggaatcagccggtagagaaagaagaactgaagctaacaatgtctcagcctcacaagagaggcaagcattgtccagatttgggggagttccacaaatgcagaacattggtcaagatttcggttcttggagagatcaagcgagtgacaggaacggtttccagctaatgagcgcgatggcaggtgccacggggattcttcagaccggtcagggactgtcccttagccttggttcacagattcttccaggaattcatcagataagccatcaaaatatggcgccgagaggcaatgagtatgcaacacagagttttccgggcgggaatcagaacttggatgttgtgagaacaattcccaactcaaagtatcttaaggcggctcaacagcttctagatgaggctgttaatgtaaagaaagctctaaagcagtttcaggcagagggagataaaaacaatgagaaccctcaagaaccgaatcagagcactcaagactcgagcacgaatcctcctgcggacatctctcagtcggagagacaagaaatgcagagcaagttgacaaaactcttgtcaatgttggatgaggtaataacttgagacctaatcttcttaatttgatcatgtgatggttaccttttataggccttttgttataatattttaaatgcaaaaaagcatacatttaaataaattgcagccataatgttgttacatttggtatatataggatatgttgaatatttaagaaaatgagatatttcttgattttggtaaaggtggatagaagatataagcaatattaccagcagatgcagatagttgtatcctcgttcgatgtgatagctggttatggagcagctaagccatacacagcactcgcccttcaaacaatttctcgccattttcgtagcctaagggatgcgatatccggacaaatcctcgtgctacgtaaatgccttggggaacaacaagatggatcagatgggaaaagagttgggattataagccggcttaagtacgttgatcaacatttaagacaacaaagaggttttatgcaacctcaagcttggagacctcaacgcggtctacctgaaaactctgttttgattctccgtgcttggctctttgagcattttcttcacccgtaagtctcccttgaatcttatctccacacattttcttcataaatagtgatgattactgtttgaaaacatgaatagttacccaaaggattctgataagatcatgctagcaagacaaacgggcttgagccgcggtcaggtaaggaatgttttatttgaagattgtttctttctcttcatagtatagtttatttattgattgttgtgtgttttatgtttgtaaaaggtttcaaactggttcataaatgcacgagtgcgtttatggaagccaatggtggaggagatatacaaggaggaattcacagagaatgattccaactcgtcttccgaaaatacaccgaaaatgtctgagataggacctgttgctgctgatgatgaagatcgagctcgagagttttcacaagaccagaccaaaccggaccatggacatggatatggcgaggaaactcgtggcatggtccaaggcagtcatatggatggtcgccggttcatggcagttgagcctacatatcatgtggctgatacgtcaagattgggtcgtggtgatgtgtccttgactctagggcttcaaaactctcaaggacaggacaatgttgtggctatgtctagtgaggcatacaacaacttttccggggtggatatttacgagaatgccatcccgggagatgaaatggagtatgtaaaccccggaagtcgccagaaccggataaattcttcacaattggtacatgattttgtagcttga

SEQ ID NO: 1879 - DNA, 1953 bp, Arabidopsis thaliana
  G1550 DNA sequence used for BLAST
tcaagctacaaaatcatgtaccaattgtgaagaatttatccggttctggcgacttccggggtttacatactccatttcatctcccgggatggcattctcgtaaatatccaccccggaaaagttgttgtatgcctcactagacatagccacaacattgtcctgtccttgagagttttgaagccctagagtcaaggacacatcaccacgacccaatcttgacgtatcagccacatgatatgtaggctcaactgccatgaaccggcgaccatccatatgactgccttggaccatgccacgagtttcctcgccatatccatgtccatggtccggtttggtctggtcttgtgaaaactctcgagctcgatcttcatcatcagcagcaacaggtcctatctcagacattttcggtgtattttcggaagacgagttggaatcattctctgtgaattcctccttgtatatctcctccaccattggcttccataaacgcactcgtgcatttatgaaccagtttgaaaccttttacaaacataaaacacacaacaatcaataaataaactatactatgaagagaaagaaacaatcttcaaataaaacattccttacctgaccgcggctcaagcccgtttgtcttgctagcatgatcttatcagaatcctttgggtaactattcatgttttcaaacagtaatcatcactatttatgaagaaaatgtgtggagataagattcaagggagacttacgggtgaagaaaatgctcaaagagccaagcacggagaatcaaaacagagttttcaggtagaccgcgttgaggtctccaagcttgaggttgcataaaacctctttgttgtcttaaatgttgatcaacgtacttaagccggcttataatcccaactcttttcccatctgatccatcttgttgttccccaaggcatttacgtagcacgaggatttgtccggatatcgcatcccttaggctacgaaaatggcgagaaattgtttgaagggcgagtgctgtgtatggcttagctgctccataaccagctatcacatcgaacgaggatacaactatctgcatctgctggtaatattgcttatatcttctatccacctttaccaaaatcaagaaatatctcattttcttaaatattcaacatatcctatatataccaaatgtaacaacattatggctgcaatttatttaaatgtatgcttttttgcatttaaaatattataacaaaaggcctataaaaggtaaccatcacatgatcaaattaagaagattaggtctcaagttattacctcatccaacattgacaagagttttgtcaacttgctctgcatttcttgtctctccgactgagagatgtccgcaggaggattcgtgctcgagtcttgagtgctctgattcggttcttgagggttctcattgtttttatctccctctgcctgaaactgctttagagctttctttacattaacagcctcatctagaagctgttgagccgccttaagatactttgagttgggaattgttctcacaacatccaagttctgattcccgcccggaaaactctgtgttgcatactcattgcctctcggcgccatattttgatggcttatctgatgaattcctggaagaatctgtgaaccaaggctaagggacagtccctgaccggtctgaagaatccccgtggcacctgccatcgcgctcattagctggaaaccgttcctgtcactcgcttgatctctccaagaaccgaaatcttgaccaatgttctgcatttgtggaactcccccaaatctggacaatgcttgcctctcttgtgaggctgagacattgttagcttcagttcttctttctctaccggctgattcctcagagtaagaaactatagcattctggatcattgaatctccgggaataaactgtgtttctggataattctccat

SEQ ID NO: 1880 - DNA, 807 bp, Arabidopsis thaliana
  G1586 cDNA Sequence
atgaatcaagaaggtgcttcacatagcccatcctccacttccaccgaaccagtccgggcacgttggtcacctaaaccggagcaaatcttgatactcgaatccatcttcaacagtggtactgttaacccaccaaaagatgaaacggtgaggataagaaagatgcttgagaaattcggtgctgtgggagacgcaaacgtcttctactggtttcaaaaccgacggtcaagatctcgccggagacaccggcagcttttagcagccaccaccgcagccgccacctccataggagctgaagaccaccagcacatgacggccatgagcatgcatcaatatccttgcagcaacaacgagattgatttggggtttggaagttgtagcaacttatcagctaattacttccttaatggatcgtcgtcatctcaaatcccttcctttttcctcggcctctcttcttcaagtggtgggtgtgagaacaacaatggtatggagaatctcttcaaaatgtatggccatgaatctgatcataatcatcagcagcagcatcatagctcaaatgctgcatcagttttaaacccatctgatcaaaactccaactcccaatacgaacaagaagggtttatgacggtgtttataaacggagttcctatggaagtaacaaaaggagcaatagacatgaaaacaatgttcggtgatgattcggtgttacttcattcctctggtcttcctcttcccactgatgagtttggtttcttgatgcattctttacaacatggacaaacttatttcctggtaccgagacagacatga

SEQ ID NO: 1881 - protein, 268 aa, Arabidopsis thaliana
  G1586 Amino Acid Sequence
MNQEGASHSPSSTSTEPVRARWSPKPEQILILESIFNSGTVNPPKDETVRIRKMLEKFGAVGDANVFYWFQNRRSRSRRRHRQLLAATTAAATSIGAEDHQHMTAMSMHQYPCSNNEIDLGFGSCSNLSANYFLNGSSSSQIPSFFLGLSSSSGGCENNNGMENLFKMYGHESDHNHQQQHHSSNAASVLNPSDQNSNSQYEQEGFMTVFINGVPMEVTKGAIDMKTMFGDDSVLLHSSGLPLPTDEFGFLMHSLQHGQTYFLVPRQT

SEQ ID NO: 1882 - DNA, 2027 bp, Arabidopsis thaliana
  G1586 Genomic Sequence
atgaatcaagaaggtgcttcacatagcccatcctccacttccaccgaaccagtccgggcacgttggtcacctaaaccggagcaaatcttgatactcgaatccatcttcaacagtggtactgttaacccaccaaaagatgaaacggtgaggataagaaagatgcttgagaaattcggtgctgtgggagacgcaaacgtcttctactggtttcaaaaccgacggtcaagatctcgccggagacaccggcagcttttagcagccaccaccgcagccgccacctccataggagctgaagaccaccagcacatgacggccatgagcatgcatcaatatccttgcagcaacaacgagattgatttggggtttggaagttgtagcaacttatcagctaattacttccttaatggatcgtcgtcatctcaaatcccttcctttttcctcggcctctcttcttcaagtggtgggtgtgagaacaacaatggtatggagaatctcttcaaaatgtatggccatgaatctgatcataatcatcagcagcagcatcatagctcaaatgctgcatcagttttaaacccatctgatcaaaactccaactcccaatacgaacaaggtgaatcattcattcatctgcatggctcatatttttttttaacaccgtaatacacattgagtttttagatcttaaaccgggatactttccaactaaatcaacatttttcaaaccatttaaactataaatatttggatgagtaatttttatataaataaaattttgaaagtgaaaaagaaagagccaaccattttttctatgagggtttaaaaccaaatttttatgttaggctaactttgtatgttgaaagctaattctcaaatctctatttttgttcttgtatctattgttcttttctttttttccagaagggtttatgacggtgtttataaacggagttcctatggaagtaacaaaaggagcaatagacatgaaaacaatgttcggtgatgattcggtgttacttcattcctctggtcttcctcttcccactgatgagtttggtttcttgatgcattctttacaacatggacaaacttatttcctggtaactaataatatataattcactttttattgttaatttatacacgataacaaaatgctcatggttaatattttcattaatgatttccacacctattttctgtttaaaactttttttttgttcatccgaaaacgattttctcatgattaaattcattatttttaccattgtttgacccaacaaaccatagttatatttgtaaataaaataccataagatattatgtgtatttcctattaaattagtatgttaaagtgtgtagaaaatggtcttaagcctaataaatagtcaagtcctaatgtctgcagaaattaacctcaagaacccatctcactctctggaactataacataaaaatatttctgcagaaaatataataaaatataaatcaatttgatgtttgtcggtttatgcatgtaataaatgaatatcgtttttgtagaaattaatatctgtaactgaagttttgtgatttaactaagctttacggattgatgcagctcatatatatggatgtatatatgtgaccttttttatttggtccaagttttgataaatataaatatgtagtatatattatttatttttaaaaataaagaatatagccaaaaacacaagaaccaataactccacttttgagtaattttgtaaaatattgagttcattggtcgaagagaccttgggaatttatattctctcttggcaaatgaatagacggtgtctttgctcaaaaaaagaagaaaaaagaatagacggtggatatataaaatgatgttaaaccatttctcgttagggttttcatttttcaatattatcagtaattagtgaactagcagttttaagaattaaaatgctctaattattccctaattaagaatctgtttttatttgttttccttttgtcatcgacaggtaccgagacagacatga

SEQ ID NO: 1883 - DNA, 2027 bp, Arabidopsis thaliana
  G1586 DNA sequence used for BLAST
tcatgtctgtctcggtacctgtcgatgacaaaaggaaaacaaataaaaacagattcttaattagggaataattagagcattttaattcttaaaactgctagttcactaattactgataatattgaaaaatgaaaaccctaacgagaaatggtttaacatcattttatatatccaccgtctattcttttttcttctttttttgagcaaagacaccgtctattcatttgccaagagagaatataaattcccaaggtctcttcgaccaatgaactcaatattttacaaaattactcaaaagtggagttattggttcttgtgtttttggctatattctttatttttaaaaataaataatatatactacatatttatatttatcaaaacttggaccaaataaaaaaggtcacatatatacatccatatatatgagctgcatcaatccgtaaagcttagttaaatcacaaaacttcagttacagatattaatttctacaaaaacgatattcatttattacatgcataaaccgacaaacatcaaattgatttatattttattatattttctgcagaaatatttttatgttatagttccagagagtgagatgggttcttgaggttaatttctgcagacattaggacttgactatttattaggcttaagaccattttctacacactttaacatactaatttaataggaaatacacataatatcttatggtattttatttacaaatataactatggtttgttgggtcaaacaatggtaaaaataatgaatttaatcatgagaaaatcgttttcggatgaacaaaaaaaaagttttaaacagaaaataggtgtggaaatcattaatgaaaatattaaccatgagcattttgttatcgtgtataaattaacaataaaaagtgaattatatattattagttaccaggaaataagtttgtccatgttgtaaagaatgcatcaagaaaccaaactcatcagtgggaagaggaagaccagaggaatgaagtaacaccgaatcatcaccgaacattgttttcatgtctattgctccttttgttacttccataggaactccgtttataaacaccgtcataaacccttctggaaaaaaagaaaagaacaatagatacaagaacaaaaatagagatttgagaattagctttcaacatacaaagttagcctaacataaaaatttggttttaaaccctcatagaaaaaatggttggctctttctttttcactttcaaaattttatttatataaaaattactcatccaaatatttatagtttaaatggtttgaaaaatgttgatttagttggaaagtatcccggtttaagatctaaaaactcaatgtgtattacggtgttaaaaaaaaatatgagccatgcagatgaatgaatgattcaccttgttcgtattgggagttggagttttgatcagatgggtttaaaactgatgcagcatttgagctatgatgctgctgctgatgattatgatcagattcatggccatacattttgaagagattctccataccattgttgttctcacacccaccacttgaagaagagaggccgaggaaaaaggaagggatttgagatgacgacgatccattaaggaagtaattagctgataagttgctacaacttccaaaccccaaatcaatctcgttgttgctgcaaggatattgatgcatgctcatggccgtcatgtgctggtggtcttcagctcctatggaggtggcggctgcggtggtggctgctaaaagctgccggtgtctccggcgagatcttgaccgtcggttttgaaaccagtagaagacgtttgcgtctcccacagcaccgaatttctcaagcatctttcttatcctcaccgtttcatcttttggtgggttaacagtaccactgttgaagatggattcgagtatcaagatttgctccggtttaggtgaccaacgtgcccggactggttcggtggaagtggaggatgggctatgtgaagcaccttcttgattcat

SEQ ID NO: 1884 - DNA, 896 bp, Arabidopsis thaliana
  G1634 cDNA Sequence
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 1885 - protein, 277 aa, Arabidopsis thaliana
  G1634 Amino Acid Sequence
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 1886 - DNA, 948 bp, Arabidopsis thaliana
  G1634 Genomic Sequence
tcattttctcgtttcaagatcttgtgagatacagtaacctccttcaccgtaaacatttgctccggaaaacttaatggcaggatcgtaggaagagaagaccgaggatagattctgaccaagaaacataactccctcctctgcattatccctgtcggtgaaccctagtttcggctcggcctgttttgagactaagcaaccgtgatcagacgatggacggctaagattggcattgagaagattgacggtggtgatgtcgtgaatgctaggccgtcgtttgtctttcgcaccggaaagctgtctttggtagtacttttgggcatgacttgcaacctgagttggtgtttttgatcccacaaagttcctcgatatgtttctccaatctcctttcccatacttgagaagccctaacaagaatctcctgcagaaaacaattaaacaaggtctcagcaaaccaagaaaacaaagtaacttgcaactcaagacaccaaagaagagtgaaacaaggatcacaaagattgaaaactttgttcacctgtgttcttcctccgtccatggaactcctttcctacggtcttgatcaaatcctctggctccattaggaagtttacgatacgcatcaaagtcacgtggactcacaacctgatcaaatccacaaggagtaactgaacggtaacccgggatcgggacaagtcctgcttcgatatcgaagaggtcttcttcaagcttagagtattgcctcatgacatctgatatggtctttccagggatcatagcagcaactttgaaccagcgatcaggcgtgtcatcagcgtagacagcaagagctcgctcaaacttcttgttctcttctttagtccagctcgagctttgcaagcacatcatctcttgaactacaaaccggtggtcagaagttggcacgtgcgagagtagtggatgcagagtctccat

SEQ ID NO: 1887 - DNA, 948 bp, Arabidopsis thaliana; identical to SEQ ID NO: 1886
  G1634 DNA sequence used for BLAST

SEQ ID NO: 1888 - DNA, 1164 bp, Arabidopsis thaliana
  G1635 cDNA Sequence
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 1889 - protein, 387 aa, Arabidopsis thaliana
  G1635 Amino Acid Sequence
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 1890 - DNA, 2037 bp, Arabidopsis thaliana
  G1635 Genomic Sequence
ttaaagtctcttctttagggtacgtaagaaaatgtgttataagtggagatgaatctcatgctcttcttcttctgttaccatctttctcttcttgtatggaccaaatcctcttgaatttgactcggagtttgttcttctgagctcagaaaatgcagacctctcacttggtttaaactcccattgacatagcattgtttcgggttctgtggtcttttccgtgtgtcccgtatcatccaccgaaccagtgtttgatccagtcgatgatccttcgttttggacagcctttcctgaatccaaacatctattttccacatcttcttgcttaagagggacttgtatccagcagctcaagagttcttcttgtgagtttcttattatgggtagtgtcttggatgatgagagtttccgtggtaatggctgaattggggatttacaatatgttgaagttgttagagaagaggacatgcctgaatcagataccaaaactgtcttcccaaagagtttaagactttgcttcgttggttccttgatcgagctctccctgtttaagagtctctcactaggaaacaactccagcttctgtacaaattgattaaaccaagaatattaagcattaagcatctaacagcaggtattgctgttaagtataaattcggttttgtttatgtcaagtaccagagtctcaagctcttcaggtgcatttgcagtggttgtaagagcagctggtggtgatgcagaagaaactggggacaagcttcgattgggtgaactcgaatcaagggaacacaatgcttctgatccaacagtggacaacacagaggttggagattgagtatcacgttctgagggagaaaccgatctacttgtttgatctgcctcgttcccaaacttacgagggtacggatgcgctggctttctcttgggacgaggaggaggtattacaatcggctctactgagctcccatcacctccagttgcttctcgagcaacctgtgtgaatacaacagaacaaagccaagtcagaacacaagtctccaaacaatgtatgtataatgattccttatttatgcagaacttaggtttgctacagagattagactgatactttctttgaacaagggtaaagatataatagcaaataagtgtataaaccttagagaaaaacttctgagcatggcttcgaatctgaactgcggtctttgagcccacatgttctgttagtgaaacaaacatatatttttgagggtccaggtaaggccataactcagtagcaagagatattactaaatcattaatttaccttctattcgtctccaagctcgcccgtataatttcaaggcttcaacaaacttcttgtgctcttcatctgtccatctctctctctcttttgttatcgtgtatggcttccgtacctaagtaagaaaagatgaactgagccacagatcttcactttacataacaatatttgacatttgatgttaaaagaaacaaaccttgggtgcatagtcatttcccccaaaactttggtcattgaattgtatctgcttgtctgcagtttcttcatctctattcctcaaagaagcgttggtaccctaaagccatcatcaagcaaaacgactttaggaaacatcattttaaggactatgacacaaagtggcattggattatttactttcttcttcagtttctcaatgaacattcattcacaaagtccaactaattaaactcgatttacatatcctaatcacaaaattccaacacagtcgattccatctcaaggattcaaatgaatgtagttgcaacacacaaatctagagagaacttatagctcaaaagaaacaagagtctgcaaatgaattgcaacgaacttgctttaactctaagctttattacttaaatgtccgtatacagtattttaaactcatagattcatttgagaccagacctgaataaagcagaaacaaaacaaaaaaagtggataaaaatcaaattttgagaccagacctgaacatttgcagtcaacggagacgacgccat

SEQ ID NO: 1891 - DNA, 2037 bp, Arabidopsis thaliana; identical to SEQ ID NO: 1890
  G1635 DNA sequence used for BLAST

SEQ ID NO: 1892 - DNA, 668 bp, Arabidopsis thaliana
  G1636 cDNA Sequence
gagtaatcatcaacgattatggcgtcaagtcagtggacgaggtcggaggataagatgtttgagcaagctttggttctttttcctgaaggatctcctaatcggtgggagagaatcgctgatcagcttcataaatctgctggtgaagttagggagcattacgaggtcttggttcatgatgttttcgagattgattctggtcgagttgatgtccctgattacatggatgactcggcggctgcggcggcgggttgggattccgctggtcagatctcttttgggtctaaacatggcgagagtgaacgcaaaagaggaactccttggacagagaacgaacacaaattgtttctgatcggattaaagagatatggtaagggagattggaggagtatctcgagaaacgttgtggtgacgaggacaccgacgcaagtcgcgagtcacgctcagaagtattttctgagacagaactcggtgaagaaggagaggaaaaggtcgagcatccatgatataactacggttgatgctactttggctatgcctgggtctaacatggactggactggccaacacgggagtcctgttcaggcgccgcagcagcaacagattatgtctgagttcggtcagcaattgaatcctggtcatttcgaggattttgggtttcggatgtgatg

SEQ ID NO: 1893 - protein, 215 aa, Arabidopsis thaliana
  G1636 Amino Acid Sequence
MASSQWTRSEDKMFEQALVLFPEGSPNRWERIADQLHKSAGEVREHYEVLVHDVFEIDSGRVDVPDYMDDSAAAAAGWDSAGQISFGSKHGESERKRGTPWTENEHKLFLIGLKRYGKGDWRSISRNVVVTRTPTQVASHAQKYFLRQNSVKKERKRSSIHDITTVDATLAMPGSNMDWTGQHGSPVQAPQQQQIMSEFGQQLNPGHFEDFGFRM

SEQ ID NO: 1894 - DNA, 772 bp, Arabidopsis thaliana
  G1636 Genomic Sequence
tccgaaacccaaaatcctcgaaatgaccaggattcaattgctgaccgaactcagacataatctgttgctgctgcggcgcctgaacaggactcccgtgttggccagtccagtccatgttagacccaggcatagccaaagtagcatcaaccgtagttatatcatggatgctcgaccttttcctctccttcttcaccgagttctgtctcagaaaatacttctgagcgtgactcgcgacttgcgtcggtgtcctcgtcaccacaacgtttctcgagatactcctccaatctcccttaccatatctctttaatccgatcagaaacaatctgcatcaataaaattcatatcaaacaatgtaattaaatcacctaaatttagcaaaattgcatttaattcctaaattctcaaaccaaccaaaaccctaatttttttgaaatgattgataaagaaacatacttgtgttcgttctctgtccaaggagttcctcttttgcgttcactctcgccatgtttagacccaaaagagatctgaccagcggaatcccaacccgccgccgcagccgccgagtcatccatgtaatcagggacatcaactcgaccagaatcaatctcgaaaacatcatgaaccaagacctcgtaatgctccctaacttcaccagcagatttatgaagctgatcagcgattctctcccaccgattaggagatccttcaggaaaaagaaccaaagcttgctcaaacatcttatcctccgacctcgtccactgacttgacgcca

SEQ ID NO: 1895 - DNA, 772 bp, Arabidopsis thaliana; identical to SEQ ID NO: 1894
  G1636 DNA sequence used for BLAST

SEQ ID NO: 1896 - DNA, 1011 bp, Arabidopsis thaliana
  G1638 cDNA Sequence
gattcgatcaacaatcgttgaaaacatgaacagaggaatcgaagttatgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacggcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtagctcacaaggtgaagatctcgaaagagcggccgctctagacaggcaaaagtaccggatcctctagctagagctttcgttcgtatcatcgg

SEQ ID NO: 1897 - protein, 298 aa, Arabidopsis thaliana
  G1638 Amino Acid Sequence
MNRGIEVMSPATYLETSNWLFQENRGTKWTAEENKKFENALAFYDKDTPDRWSRVAAMLPGKTVGDVIKQYRELEEDVSDIEAGLIPIPGYASDSFTLDWGGYDGASGNNGFNMNGYYFSAAGGKRGSAARTAEHERKKGVPWTEEEHRQFLMGLKKYGKGDWRNIARNFVTTRTPTQVASHAQKYFIRQVNGGKDKRRSSIHDITTVNIPDSPDAAAADNATANAPCSPPSVGGNQRETSEWEGQTLYDETAAAFYNQNAFSETLLGMSSTPYMAKLQEQSFLNASQFESYNAYLQM

SEQ ID NO: 1898 - DNA, 1477 bp, Arabidopsis thaliana
  G1638 Genomic Sequence
atgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacaggtaaacttaaatcatctctctacgttaacgtcaatgcttttcttctctagatttggacccctttacactttcttttataaaaatacgtacgtcttttttcttggaaacgtgtttatgtatacgtataaagatacgcatatcgtataaatatatatacgtatgtaatttataaaattaaaactatacagtcatccaccaaaacaattgtatctttagtgcgtgtctatatgacctacgtatgggttagacagagaggcagacacacacacattattttgtagagtagatactttacatgtttatgttaatctcaaaaaaattatttaccctttttttatgtatcgagttaataaatctattagtaaactatatacagagcagataaaatttgtttcttctaggctcttgatgtgtggaatgggtttcattggtgtcttggtgcggttatttgttttgcacgcatggacattgtactgggacatggaacattagtataaacatgagtttttattttggctataaaatctagtttagttgtttgtatatgtgttaagagtcgatttggtttatttaggttttggtatggttaatgaatgtgcagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacagcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtag

SEQ ID NO: 1899 - DNA, 1477 bp, Arabidopsis thaliana; identical to SEQ ID NO: 1898
  G1638 DNA sequence used for BLAST

SEQ ID NO: 1900 - DNA, 1300 bp, Arabidopsis thaliana
  G1640 cDNA Sequence
ttcgccagatccttcctctatataaggaagttcatttcatttggagaggtttcgctgacaagctgctctagcttatctggtaccgtcgacctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattggcggccgctctagacaggcctcgtaccggatctctagctagagctttcgttcgtatcatcggtttcgacaacgttcgtcaagt

SEQ ID NO: 1901 - protein, 342 aa, Arabidopsis thaliana
  G1640 Amino Acid Sequence
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 1902 - DNA, 2147 bp, Arabidopsis thaliana
  G1640 Genomic Sequence
tcactccaatgttatctctccaatatctgagagatcccatagatcatcactttgacaagtgacattaccttgaaactcccaatcaagcaactcctcatcaaccccaaacccaacttctgaagaattacatagaccaacccaccaatctttatcattattttcatttgaattcgaacttaaaaaacttccctctctttctctttccaccgtcatatcatgatcaacctctgtgattcctacgtgaccaatctttgtctcgcttccttgttcttcttcaaacaaattaacacaacaactactattgtccccactctcacacaccttttcatcatttactccaatcacagcctcttcactagtgcattcccagacacaactactcaagagccgttctaactcaccatccaaccactcataaggccccaaagactctccttcaaaattaccattttgccctccctcactgaaatcactctctagctccttaggttgtgagaaacattgtgaggccgtcaccatttgcttgtgtttcttcatggatgacctactagtccttcccttcttcttcttcttggtcttgttattgttcttggctccagaagacgatgaacaagatttcttcaagactacatcgttgacgagtagattgtgtccatctccggaaacggcagtgaaggcatagattttgcggctgagatgtgagttccaatagtttttaatttcgttgtctgttcttcctggtagatgtgttgcaataagtgaccatctataagaaaatagtcacatgcacacacgtgagacaacataaatttagacaaatcaattaattatgtgtacacactctttacaagttggcttctcattaattcaataccaatactacaacaaaatgtatgacgtcagaaaaattgcatggtttagttatgtgtaactaatttttctttaaaaatggttggactgttcctcatttttttataagagttagcactgaatatattcagatttcgtagaaacaccttaattctagaaatgagttgatttattggtaaataagtttctaaattttattgcaactaaaaataccgaaactcaatgaagaagattagaagtttaggcacagtaaaattcaaatttggagctttaacaatgcattaactctatagactcatgaccactttgccactcattgttacagtgaccaactggcaatagagccagtaacaatcagggccgtacacaaaacacacatgagacaagactaattagagaggtcaattcgcttagatatatagcaacataatgccaaagcttcttattgacaaaaagtcaaattggatattctcgtatatatatatatatatatatattttttcaaaggctggaccattccaacagtgatcaaccgctgaaatgttacatggcaatacatttgataaattttgtttcttatttatttttggacggttggaacggagtctgaccatttctatatgtttcttaagttgacaagacatgcatataattgtactgtgtacgtgaccccagcattaacagtcactattcacatagtggcaaaattgtaaatataaaaacgaaattctgaatcacatataaatgaacgattgggaaattgattaattttggtttaatacctgttgccgagaagggaatgcaacttgacgattatttcttcttcgtcggaagtaatatttcctctttttaagtctcttcttaagtagtttatccaccttagtctacagctctttccacatctcaacaatcctacacattttttaagtaactattaaaacatgtataactacaacgcttttttctattaatataacatcacaagttttggttttagatatattggcacatttttttgttttcatgcatcaacaacttgaagaaattagtacttttttgaatgttaaaatcgaatcgattactaaactgagagatgtatcgacaattaggaaaggtaattttttttatataaagatgtatataccagctttcttaggcaaagatcgccaagaaccttcaccattggtctgaatatacttggtgaggatctcatcttcctcggctgtccatctccctctcttcaacccgattttctcacaacacggagcccttcccat

SEQ ID NO: 1903 - DNA, 2147 bp, Arabidopsis thaliana; identical to SEQ ID NO: 1902
  G1640 DNA sequence used for BLAST

SEQ ID NO: 1904 - protein, 434 aa, Arabidopsis thaliana
  G1643 Amino Acid Sequence
MIRQFLPKINWDSLDIKDRSAAECEARWMSSEDPLINHGPWTAAEDKNLLRTIEQTSLTDWVDIAVSLGTNRTPFQCLARYQRSLNPSILKKEWTAEEDDQLRTAVELFGEKDWQSVANVLKGRTGTQCSNRWKKSLRPTRKGTWSLEEDKRVKVAVTLFGSQNWHKISQFVPGRTQTQCRERWLNCLDPKVNRGKWTEEEDEKLREAIAEHGYSWSKVATNLSCRTDNQCLRRWKRLYPHQVALLQEARRLQKEASVGNFVDRESERPALVTSPILALPDISLEPEPDSVALKKKRKAKQKKSDAERQPKRRRKGLKNCSGDVCRQENETVCENEPNNGGEERMLALECHDEIQDNAKEKPKQRRKSVAETVCENEPNNGGEERMLALECDNEIQDNAKEKRKRRRKSVAETSNNTTGLKKLTPRRRKISRPL

SEQ ID NO: 1905 - DNA, 1858 bp, Arabidopsis thaliana
  G1643 Genomic Sequence
atgattaggcagtttcttccgaaaattaactgggattcgttggatatcaaggaccgttctgctgcagaatgtgaagctcggtaagttcctcctttatttgaactctggttactaagataaatcagcttttaatcatctatgggtgtacatataccatcactctcttattttgatatattagtggattttcttatcctgtgcctcattgtaggtggatgagctcggaagatccattgattaaccacggtccgtggactgcagcagaggacaaaaacctactccgaactatcgaacaaacgagtcttacagactgggttgatatcgcggtgtcactagggacaaataggaccccatttcaatgtttggctcgatatcagagaagcttgaatccaagcatattgaaaaaagaatggactgcagaggaagatgaccaacttcgtactgcagtagagttatttggggagaaagactggcaatctgttgcaaatgtattaaaaggaagaactggaactcagtgctcgaataggtcagttttatcttctacattcacccatttctttatgagttagatattaattactgtagtatgttaagaggtagcctcgtccctttccctccatctgcaaattatatgaatttaatttagttcagttcgatcaattgcctcaagagctagtttgtttggtcaaaaggtctatagggtttataaaccacccataaagtccatgtttagtcgatgtgggattatatcataacctcaatatgcactcatgtctcattggtgacaatcctctaggattttagattgagttacaaggttatgttctgtcattttatgtgcttgtttatgtctgcattcagatacatgattgaatatctaatttcattctctctatactctcagatggaaaaagtcgcttcgccctaccagaaaagggacatggagcttagaggaagacaaacgtgtaaaggtagctgtgacactctttggatctcaaaactggcataaaatttctcagtttgttcctggacggactcagactcagtgtcgggagagatggttaaattgtttagatcccaaagtaaatcgtgggaagtggactgaggaagaggatgaaaagttgagagaagcaattgcagagcatggatatagctggtctaaggtggctactaatctgtcatgtcgtactgacaatcagtgcttgaggagatggaagagattatatcctcatcaagtggctcttttacaagaagctagaaggttacaaaaagaagctagtgtaggtaattttgttgatcgggaatcagagcgtcctgctcttgtcacaagccctattttggcactaccggatatatctctagagccagaacccgatagtgtagccctgaagaagaaacgcaaagccaagtaagttaaatagattattccttacatacacacacacacacacgtagcttttgtgaatctaactaaattcacctttttgttgattcaggcagaagaagtcagatgcagagagacaaccaaagagacggagaaaaggattaaagaactgctcaggagatgtatgtagacaagagaatgagactgtttgtgaaaatgaaccgaacaatggaggagaggaaaggatgttggcattggaatgtcatgacgagatccaagacaatgcaaaggagaagccaaaacaaagacgcaaaagtgttgcagaaactgtttgtgaaaatgaaccaaacaatggaggagaggagaggatgttggcattggaatgtgataacgagatccaagacaatgcaaaggagaaacgaaaacgaagacgcaaaagtgttgcagaaacatctaacaacaccactggtttaa

SEQ ID NO: 1906 - DNA, 1858 bp, Arabidopsis thaliana; identical to SEQ ID NO: 1905
  G1643 DNA sequence used for BLAST

SEQ ID NO: 1907 - DNA, 800 bp, Arabidopsis thaliana
  G1646 cDNA Sequence
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagtag

SEQ ID NO: 1908 - protein, 250 aa, Arabidopsis thaliana
  G1646 Amino Acid Sequence
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 1909 - DNA, 477 bp, Arabidopsis thaliana
  G1646 Genomic Sequence
cttacccttggctatcgagattaccatggccgctacttcctccacttccataagacacatcatcaccaccaccagctgaattctgccaaacgctttgccatgcctgagaaggaggctgagcataaacaccgctaggatccatcgccggtcttccaatcatcatccctccaggaaccgccggttgtcccatcggtggataataataaggaacaccgctcgcggcgggagcaaccatacctcctccaccaagagccgatgctgcatcttcctcttccttgatctcttccctaggaacaatatcaacaaggaaatcgaagatatcggttctagtaatcgcagcagcgatatcgtttttctgaagcgtacgacgtttgttctcttcagcgtgaagccaagatctaatcgtaagttcgagaatgaaaagctcacaagctttcgcgaagagaatcggtgcttcggcggagatcatacgcacat

SEQ ID NO: 1910 - DNA, 477 bp, Arabidopsis thaliana; identical to SEQ ID NO: 1909
  G1646 DNA sequence used for BLAST

SEQ ID NO: 1911 - DNA, 1423 bp, Arabidopsis thaliana
  G1650 cDNA Sequence
tcgacagtcacaaatgtccatatgagtttctgggcgacttctatcagaatttttgttcataattttttttattgtatcaagggatgacttggaaaccgaagatgcttatattatcccatgatctaatctcaccagaaaaatacatcatgggtgaagatgatatcgtggagctcttagggaagagcagccaagtagttacaagtagccagacacaaacaccctcttgcgatcctcctctcattctccggggcagcggaagcggggacggagaaggaaatggtcctctaccgcagcctccgcctcccctgtaccatcagcagagtctctttatccaagaagacgaaatggcttcttggcttcaccagcctaatcgccaagattatctctactcccaacttctttactccggagtagcctcgactcacccgcaaagtttggcctccctagaaccaccaccaccacctagggctcagtacattctggcggcggatagaccgaccggtcatattttggccgagagaagggcggagaattttatgaatatctcgaggcaaagagggaacatatttcttggcggtgttgaagctgtaccgtcgaactcgaccctgttgtcttcagccactgaatcaataccagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccagggaactgaagaagctcgtgattcgacgtctagtaagaggtcacgagctgcaataatgcataaactctccgaaaggagacggagacaaaagattaacgagatgatgaaggctttgcaagaactccttcctcgctgcacaaagactgatagatcttccatgctggatgatgttatagagtacgtgaaatctctacagagccaaatacaggatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctccagc

SEQ ID NO: 1912 - protein, 371 aa, Arabidopsis thaliana
  G1650 Amino Acid Sequence
MTWKPKMLILSHDLISPEKYIMGEDDIVELLGKSSQVVTSSQTQTPSCDPPLILRGSGSGDGEGNGPLPQPPPPLYHQQSLFIQEDEMASWLHQPNRQDYLYSQLLYSGVASTHPQSLASLEPPPPPRAQYILAADRPTGHILAERRAENFMNISRQRGNIFLGGVEAVPSNSTLLSSATESIPATHGTESRATVTGGVSRTFAVPGLGPRGKAVAIETAGTQSWGLCKAETEPVQRQPATETDITDERKRKTREETNVENQGTEEARDSTSSKRSRAAIMHKLSERRRRQKINEMMKALQELLPRCTKTDRSSMLDDVIEYVKSLQSQIQDVLNGTCYDSTDDVCGEYTTTVHAPHGHGYESASCIHTFP

SEQ ID NO: 1913 - DNA, 1718 bp, Arabidopsis thaliana
  G1650 Genomic Sequence
ctagggaaaggtatgaatgcaggaggccgattcatacccatggccatgtggggcatgtactgttgttgtatattccccgcatacatcatcggtggaatcataacatgtcccattgagaacatctggcataaaaacctcgattcagatatgaaatctcactcatgacctaaagatccttaaatgtttaccctacaaaatttgggaagcaaagacctcaagaacagggctattaggccatctcatctaaactttataaatcttccaggaaatgaatctgcggacattcaaactgtttccatgttcaaactcacattctgtttttgaggacatacctgtatttggctctgtagagatttcacgtactctataacatcatccagcatggaagatctatcagtctgatcagagtagacacagaatcagaatcaacgttaaagttaaataacaactagttaattaaaaaagaaactgtaataacctttgtgcagcgaggaaggagttcttgcaaagccttcatcatctcgttaatcttttgtctccgtctctgtttaacaaaaaaaaaacaagttttaaaggagatgaaacagatagtccattattcaaactcagaatcttgaaattccaatggaagcataagaaccctttcggagagtttatgcattattgcagctcgtgacctcttactagacgtcgaatcacgagcttcttcagttccctgtacgccaagaaacagaaagatacaaattaagcttcaactgctaaactgcacgagtcaagtgactaacacgcgctgacatgtttgcgtaaagttaacctatatatgggagctctgactcacctggttttcgacatttgtttcctctctcgtttttctcttccgttcatcggtgatatccgtctccgtcgctggttgtctctgaaccggctctgtttcggccttgcacaacccccaagattgtgttcccgccgtctcaatcgccaccgcctttcccctcggaccaagaccaggaactgcaaaagtacgagatactccgccagtgactgttgctcgactctcggtgccgtgagtcgctggtattgattcagtggctgaagacaacagggtcgagttcgacggtacagcttcaacaccgccaagaaatatgttccctctttgcctcgagatattcataaaattctccgcccttctctcggccaaaatatgaccggtcggtctatccgccgccagaatgtactgagccctaggtggtggtggtggttctagggaggccaaactttgcgggtgagtcgaggctactccggagtaaagaagttgggagtagagataatcttggcgattaggctggtgaagccaagaagccatttcgtcttcttggataaagagactctgctgatggtacaggggaggcggaggctgcggtagaggaccatttccttctccgtccccgcttccgctgccccggagaatgagaggaggatcgcaagagggtgtttgtgtctggctacttgtaactacttggctgctcttccctaagagctccacgatatcatcttcacccctaaactcaaacaaaaccaaaaccactaaaatatacacctcatattggaataaacatgcaagtaagagagaaagaaattcgaaaatgaacttacatgatgtatttttctggtgagattagatcatgggataatataagcatcttcggtttccaagtcat

SEQ ID NO: 1914 - DNA, 1845 bp, Arabidopsis thaliana
  G1650 DNA sequence used for BLAST
tcaagaaaacattttctgttttgttcttttgtcttctctaaggagaagagacattgtctcttgctctgtttcttcattctctctaaataaatcaacaggacctacaccttccgccatatgagcctgcctagggaaaggtatgaatgcaggaggccgattcatacccatggccatgtggggcatgtactgttgttgtatattccccgcatacatcatcggtggaatcataacatgtcccattgagaacatctggcataaaaacctcgattcagatatgaaatctcactcatgacctaaagatccttaaatgtttaccctacaaaatttgggaagcaaagacctcaagaacagggctattaggccatctcatctaaactttataaatcttccaggaaatgaatctgcggacattcaaactgtttccatgttcaaactcacattctgtttttgaggacatacctgtatttggctctgtagagatttcacgtactctataacatcatccagcatggaagatctatcagtctgatcagagtagacacagaatcagaatcaacgttaaagttaaataacaactagttaattaaaaaagaaactgtaataacctttgtgcagcgaggaaggagttcttgcaaagccttcatcatctcgttaatcttttgtctccgtctctgtttaacaaaaaaaaaacaagttttaaaggagatgaaacagatagtccattattcaaactcagaatcttgaaattccaatggaagcataagaaccctttcggagagtttatgcattattgcagctcgtgacctcttactagacgtcgaatcacgagcttcttcagttccctgtacgccaagaaacagaaagatacaaattaagcttcaactgctaaactgcacgagtcaagtgactaacacgcgctgacatgtttgcgtaaagttaacctatatatgggagctctgactcacctggttttcgacatttgtttcctctctcgtttttctcttccgttcatcggtgatatccgtctccgtcgctggttgtctctgaaccggctctgtttcggccttgcacaacccccaagattgtgttcccgccgtctcaatcgccaccgcctttcccctcggaccaagaccaggaactgcaaaagtacgagatactccgccagtgactgttgctcgactctcggtgccgtgagtcgctggtattgattcagtggctgaagacaacagggtcgagttcgacggtacagcttcaacaccgccaagaaatatgttccctctttgcctcgagatattcataaaattctccgcccttctctcggccaaaatatgaccggtcggtctatccgccgccagaatgtactgagccctaggtggtggtggtggttctagggaggccaaactttgcgggtgagtcgaggctactccggagtaaagaagttgggagtagagataatcttggcgattaggctggtgaagccaagaagccatttcgtcttcttggataaagagactctgctgatggtacaggggaggcggaggctgcggtagaggaccatttccttctccgtccccgcttccgctgccccggagaatgagaggaggatcgcaagagggtgtttgtgtctggctacttgtaactacttggctgctcttccctaagagctccacgatatcatcttcacccctaaactcaaacaaaaccaaaaccactaaaatatacacctcatattggaataaacatgcaagtaagagagaaagaaattcgaaaatgaacttacatgatgtatttttctggtgagattagatcatgggataatataagcatcttcggtttccaagtcat

SEQ ID NO: 1915 - DNA, 1487 bp, Arabidopsis thaliana
  G1653 cDNA Sequence
cgcttgacttgagtacgaataagcatttatcctaggcttctctctctctctctctttcctaaaagaacctgtgacttgcttctgctacattagatttgatgctctgttgatttagttttgttttctctttcctctttctccactgtataaaatcctgctaaactagtttacttcagttgttccttgtcaaagtagcaaaaccaggttctgaaattggaaaactttttttgtcctgagggttcctggttgttgttgaagcagaggaatgggtggtgagagtaatgaaggaggagagatgggctttaagcatggagatgatgagagtggtgggatctctagagttggaattacatcaatgcccttgtatgcaaaggcagatcctttcttctcttctgcagattgggatccagttgtcaatgctgctgctgctggcttctccagctctcattaccatccttccatggcgatggataatccagggatgagttgcttctctcattaccaacccggttctgtttccggttttgcagcagacatgcctgctagtcttcttccgtttggtgattgtggtggtggtcaaattggtcattttcttggttcagacaagaaaggggaaagattgatcagagctggagaatcatctcatgaggatcatcatcaggtttcagatgatgctgttcttggtgcttccccagttgggaaaagaaggctacctgaagccgaatcacaatggaacaagaaagctgtggaggaatttcaagaagaccctcaaaggggaaatgatcagagccagaagaagcataaaaatgatcagagtaaagagacggtgaacaaggagagctcacaaagtgaagaagcaccgaaagaaaactacattcatatgagggcaagaagaggtcaagccactaatagtcacagtcttgcagagcgggttagaagagaaaagatcagtgaaaggatgagattgcttcaagaacttgttcccggatgcaacaagatcaccggaaaagcggttatgctcgatgaaataatcaactatgttcagtcattgcaacagcaagttgagtttttgtctatgaaacttgcgacggtgaatccagagatcaatattgatatagacaggattctcgccaaagatcttctgcagtcaagagacagaaacactcctacactcgggctgaatccttttgccggttttcaagggaacataccaaacctttctgccaccacaaatccacaatacaacccactacctcagacaacactagagagtgaactacaaaacctttaccagatgggattcgtctcaaatccatcgactatgtccagtttctcacctaatggtcgattgaaacctgagctctagtacttcaaggacacggaaaatttgcagggagtttgtatagaagatggctttggttctaagtatcatatgtgttcgttcttccatattatttgttctaagcacaaggatttggattctcagt

SEQ ID NO: 1916 - protein, 366 aa, Arabidopsis thaliana
  G1653 Amino Acid Sequence
MGGESNEGGEMGFKHGDDESGGISRVGITSMPLYAKADPFFSSADWDPVVNAAAAGFSSSHYHPSMAMDNPGMSCFSHYQPGSVSGFAADMPASLLPFGDCGGGQIGHFLGSDKKGERLIRAGESSHEDHHQVSDDAVLGASPVGKRRLPEAESQWNKKAVEEFQEDPQRGNDQSQKKHKNDQSKETVNKESSQSEEAPKENYIHMRARRGQATNSHSLAERVRREKISERMRLLQELVPGCNKITGKAVMLDEIINYVQSLQQQVEFLSMKLATVNPEINIDIDRILAKDLLQSRDRNTPTLGLNPFAGFQGNIPNLSATTNPQYNPLPQTTLESELQNLYQMGFVSNPSTMSSFSPNGRLKPEL

SEQ ID NO: 1917 - DNA, 1757 bp, Arabidopsis thaliana
  G1653 Genomic Sequence
atgggtggtgagagtaatgaaggaggagagatgggctttaagcatggagatgatgagagtggtgggatctctagagttggaattacatcaatgcccttgtatgcaaaggcagatcctttcttctcttctgcagattgggatccagttgtcaatgctgctgctgctggcttctccagctctcattaccatccttccatggcgatggataatccagggatgagttgcttctctcattaccaacccggttctgtttccggttttgcagcagacatgcctgctagtcttcttccgtttggtgattgtggtggtggtcaaattggtcattttcttggttcagacaagaaaggggaaagattgatcagagctggagaatcatctcatgaggatcatcatcaggtttcagatgatgctgttcttggtgcttccccagttgggaaaagaaggctacctgaagccgaatcacaatggaacaaggtataaataaacttcttgaactggatttggtagaattaggaaagactaaagcttttgatggtttagggctgaaataattgagtgttgttaaaattggcagaaagctgtggaggaatttcaagaagaccctcaaaggggaaatgatcagagccagaagaagcataaaaatgatcagagtaaagagacggtgaacaaggagagctcacaaagtgaagaagcaccgaaagaaaactacattcatatgagggcaagaagaggtcaagccactaatagtcacagtcttgcagagcgggtaaggactcttttacctgtatatagattatgagaatctgctctttgttttctgccaattactggtgctgagaagtttgctatttcttttgttgttttgaaggttagaagagaaaagatcagtgaaaggatgagattgcttcaagaacttgttcccggatgcaacaaggtattggacttagaggttacttttagcagtatggtttccaacgaaattttgctcaagttttcattgttggtaattgttcaactagatcaccggaaaagcggttatgctcgatgaaataatcaactatgttcagtcattgcaacagcaagttgaggtaagattatcccagtaatgcgagattcttgaaactctcaagttagtttggtgtgaaagaggttttctttcttgaaaaactgcttttattttcttcagtttttgtctatgaaacttgcgacggtgaatccagagatcaatattgatatagacaggattctcgccaaagatgtaagagctcaaaatcccccataacttcacattgaaataatagtttgcaagttttgaataagagtactaaacttgccattttctccttttagcttctgcagtcaagagacagaaacactcctacactcgggctgaatccttttgccggttttcaagggaacataccaaacctttctgccaccacaaatccacaatacaacccactacctcaggtaagcaaccgctttgaagaaattaaacaacatattatgttcaatgttttggtattgctgtaaatagtctttcttgtctcatcttgcagacaacactagagagtgaactacaaaacctttaccagatgggattcgtctcaaatccatcgactatgtccagtttctcacctaatggtaactaaaagctacacaagcttgcttctctcatatatctatctgtcgtttcctttgaattgtctttaaaacatcttcttcttatcttaggtcgattgaaacctgagctctag

SEQ ID NO: 1918 - DNA, 1652 bp, Arabidopsis thaliana
  G1653 DNA sequence used for BLAST
ttagttaccattaggtgagaaactggacatagtcgatggatttgagacgaatcccatctggtaaaggttttgtagttcactctctagtgttgtctgcaagatgagacaagaaagactatttacagcaataccaaaacattgaacataatatgttgtttaatttcttcaaagcggttgcttacctgaggtagtgggttgtattgtggatttgtggtggcagaaaggtttggtatgttcccttgaaaaccggcaaaaggattcagcccgagtgtaggagtgtttctgtctcttgactgcagaagctaaaaggagaaaatggcaagtttagtactcttattcaaaacttgcaaactattatttcaatgtgaagttatgggggattttgagctcttacatctttggcgagaatcctgtctatatcaatattgatctctggattcaccgtcgcaagtttcatagacaaaaactgaagaaaataaaagcagtttttcaagaaagaaaacctctttcacaccaaactaacttgagagtttcaagaatctcgcattactgggataatcttacctcaacttgctgttgcaatgactgaacatagttgattatttcatcgagcataaccgcttttccggtgatctagttgaacaattaccaacaatgaaaacttgagcaaaatttcgttggaaaccatactgctaaaagtaacctctaagtccaataccttgttgcatccgggaacaagttcttgaagcaatctcatcctttcactgatcttttctcttctaaccttcaaaacaacaaaagaaatagcaaacttctcagcaccagtaattggcagaaaacaaagagcagattctcataatctatatacaggtaaaagagtccttacccgctctgcaagactgtgactattagtggcttgacctcttcttgccctcatatgaatgtagttttctttcggtgcttcttcactttgtgagctctccttgttcaccgtctctttactctgatcatttttatgcttcttctggctctgatcatttcccctttgagggtcttcttgaaattcctccacagctttctgccaattttaacaacactcaattatttcagccctaaaccatcaaaagctttagtctttcctaattctaccaaatccagttcaagaagtttatttataccttgttccattgtgattcggcttcaggtagccttcttttcccaactggggaagcaccaagaacagcatcatctgaaacctgatgatgatcctcatgagatgattctccagctctgatcaatctttcccctttcttgtctgaaccaagaaaatgaccaatttgaccaccaccacaatcaccaaacggaagaagactagcaggcatgtctgctgcaaaaccggaaacagaaccgggttggtaatgagagaagcaactcatccctggattatccatcgccatggaaggatggtaatgagagctggagaagccagcagcagcagcattgacaactggatcccaatctgcagaagagaagaaaggatctgcctttgcatacaagggcattgatgtaattccaactctagagatcccaccactctcatcatctccatgcttaaagcccatctctcctccttcattactctcaccacccat

SEQ ID NO: 1919 - DNA, 871 bp, Arabidopsis thaliana
  G1655 cDNA Sequence
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 1920 - protein, 207 aa, Arabidopsis thaliana
  G1655 Amino Acid Sequence
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 1921 - DNA, 624 bp, Arabidopsis thaliana
  G1655 Genomic Sequence
ttaagttccggtcaacgtcgtccgtggtgcggctgcggttaaaagttcggcgagagcctccatggctcgaacctgcatctctaacgctgcgatgtaatcggtcgcttcatctaaaagattcggtacagagactttccggcaaccaggaaccaaacggccaagaatcttcagttttctctcaaccgccggtaacttaatccgattcgtctccgtgagaccttttctcgatttacaatttcccgttgactttttcgcctttctatgtttcttcagcttcgctcggacgcgactcgctaaaatcgctctgctccaccgagtcgtaccacgagcggacgcagctagaactcgatccgccgtatcacgtatctccctcgccgcgccggagacgagtttatcggtctcgttgttgctggtggtggaagatctctgacgaactcggcgtaaagcttcgacgagcttacaagcgtagatctgttgcacacgattcgttttccatctcttcaagctttcttcgttgacacgtcgtgcctctatctccgcctccgccgtctctgatatcctcggcttctttcttcgagacgattcacctgtgttttcgatgctcgggaacagagactccaccat

SEQ ID NO: 1922 - DNA, 624 bp, Arabidopsis thaliana; identical to SEQ ID NO: 1921
  G1655 DNA sequence used for BLAST

SEQ ID NO: 1923 - DNA, 1564 bp, Arabidopsis thaliana
  G1664 cDNA Sequence
ctctctctctctctctactagtttgacatgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaaatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgagcaatgtcaagaagaccatgacgtgttacctgaacaaatcaaagcagtgcttttagatacagcaggttacgctggtttggtttgattgcgaagcagaaggaagcatctgtgtggaacagagctagatctaagtccttgttctgttttagtcagcaattttcttacttagtttcatcaatttcaatcatgtatggaagatgataactgttttattttagctatgagaacatgtgtttggggaacaatagttgcaacctttgagcaaaaaa

SEQ ID NO: 1924 - protein, 450 aa, Arabidopsis thaliana
  G1664 Amino Acid Sequence
MNSDGVWLDGSGESPEVNNGEAASWVRNPDEDWFNNPPPPQHTNQNDFRFNGGFPLNPSENLLLLLQQSIDSSSSSSPLLHPFTLDAASQQQQQQQQQQEQSFLATKACIVSLLNVPTINNNTFDDFGFDSGFLGQQFHGNHQSPNSMNFTGLNHSVPDFLPAPENSSGSCGLSPLFSNRAKVLKPLQVMASSGSQPTLFQKRAAMRQSSSSKMCNSESSSEMRKSSYEREIDDTSTGIIDISGLNYESDDHNTNNNKGKKKGMPAKNLMAERRRRKKLNDRLYMLRSVVPKISKMDRASILGDAIDYLKELLQRINDLHTELESTPPSSSSLHPLTPTPQTLSYRVKEELCPSSSLPSPKGQQPRVEVRLREGKAVNIHMFCGRRPGLLLSTMRALDNLGLDVQQAVISCFNGFALDVFRAEQCQEDHDVLPEQIKAVLLDTAGYAGLV

SEQ ID NO: 1925 - DNA, 1635 bp, Arabidopsis thaliana
  G1664 Genomic Sequence
atgaacagcgacggtgtttggcttgacggctccggtgaatctccggaagttaataacggtgaagctgcgtcttgggtcagaaacccagatgaagactggttcaataacccaccaccaccacaacacactaatcaaaacgacttcagattcaatggtggctttcctttaaacccctcagagaatctgcttcttcttcttcagcaatcgattgattcttcttcttcttcttctccgttattacatcctttcacactcgacgctgcttcacagcaacaacaacaacaacaacaacaacaggaacagtctttcttagctacgaaagcttgtatagtttctcttctcaacgtcccaaccatcaataacaacactttcgatgacttcggctttgactctggtttcttaggacaacaattccatggaaatcatcaatctccgaactcgatgaatttcactggcttaaaccactcagtaccggattttcttccagctccggaaaacagctcaggatcatgtggattgagtcctctgttctcaaacagagcaaaggttttaaaaccgttacaggtaatggcttcatctggctcgcagccaactctgtttcagaaacgagctgcaatgcgtcagagctcgagtagcaaaatgtgcaattctgagagttcttctgaaatgaggaaatcgagctacgagagagagattgacgatactagtaccggaatcatcgatatctctggattgaattacgaatctgatgaccataatactaataacaacaaaggtaagaagaaaggaatgcctgcaaagaatcttatggctgagagaagaagaaggaagaagcttaatgataggctttacatgcttagatcagttgttcccaagatcagcaaagtaaccaaaaagattcttccttttttctctttgttctccttaataacttcttgtgtcactaattttgggttgcaaatgtagatggatagagcatcaatacttggagatgctattgattacctcaaagagcttttacaaagaatcaacgatcttcacaccgaacttgaatctactccaccgagttcttcaagcttgcatccgttaacaccgactccacaaacgctgtcttaccgtgttaaggaagagttgtgtccatcttcctccttgccaagtcctaaaggccaacaaccaagagtaagaataagctcaattgctttctagtggacaaagctgtattctttaattttcttagtaacgcttctttgttttgatataggttgaggttagattaagagaaggaaaggcagtgaacatacacatgttctgtggacgtagaccaggtcttttactttccaccatgagagctttggataacttaggattggatgttcaacaagcggtgattagctgtttcaatggttttgctttggatgttttccgcgctgaggtaatatagttgttaagatgctatgctgatcactgattagtaaaactagcagtcaaagaatagttatttgagagaatgattagtatacaagtaacaacatgttttgtgtttctaatcagcaatgtcaagaagaccatgacgtgttacctgaacaaatcaaagcagtgcttttagatacagcaggttacgctggtttggtttga

SEQ ID NO: 1926 - DNA, 1635 bp, Arabidopsis thaliana; identical to SEQ ID NO: 1925
  G1664 DNA sequence used for BLAST

SEQ ID NO: 1927 - DNA, 938 bp, Arabidopsis thaliana
  G1667 cDNA Sequence
tcgacccatccctactcctcacaatcattcttttggtgtctctaccatttaataattcaccaaaatctccttacttaaactcacaaactcctcacaaattttctgaatctttcagttgaacatataacaacattcataacaatggctggaggtacagctctaactccaacctctgtaggatccaagtctgttccaatgaggaaccatgaagcaacagagagaggcaacaccaacaacaacctgagagcattacccaaagccgtccaaccggtttcatcaatcgaaggagagatggctaagaggccacgtggcagacccgctggctccaagaacaaacccaaaccaccaatcattgtgactcacgacagtccaaattccctcagagctaacgccgttgagatcagctcaggttgtgacatctgtgagactttatcggattttgcaagaaggaaacagagaggtctctgcattctcagtgccaatggttgtgtcaccaatgtgacattaaggcaaccagcttcatcaggagcaattgtcacattacacggacgttacgagatcctctcattgcttggatcaatcttgcctccaccagcaccacttggaataactggtctgaccatttacttagccggacctcaaggacaggttgttggtggaggagtggttggtgggctaatcgcatctggtcctgttgttctcatggctgcatctttcatgaatgctgtttttgatcgtcttcctatggatgatgatgaagctgcctctatgcagaaccagcagtactaccagaatggaagatcccgtcctttagatgacattcatggactgcctcaaaatctgctcactaatggaaactcggcttctgatatctactcttgggggccttggaatcaaagataaatgtgtctgtaggttgagagagaaccgtaagtctg

SEQ ID NO: 1928 - protein, 253 aa, Arabidopsis thaliana
  G1667 Amino Acid Sequence
MAGGTALTPTSVGSKSVPMRNHEATERGNTNNNLRALPKAVQPVSSIEGEMAKRPRGRPAGSKNKPKPPIIVTHDSPNSLRANAVEISSGCDICETLSDFARRKQRGLCILSANGCVTNVTLRQPASSGAIVTLHGRYEILSLLGSILPPPAPLGITGLTIYLAGPQGQVVGGGVVGGLIASGPVVLMAASFMNAVFDRLPMDDDEAASMQNQQYYQNGRSRPLDDIHGLPQNLLTNGNSASDIYSWGPWNQR

SEQ ID NO: 1929 - DNA, 854 bp, Arabidopsis thaliana
  G1667 Genomic Sequence
atggctggaggtacagctctaactccaacctctgtaggatccaagtctgttccaatgaggaaccatgaagcaacagagagaggcaacaccaacaacaacctgagagcattacccaaagccgtccaaccggtttcatcaatcgaaggagagatggctaagaggccacgtggcagacccgctggctccaagaacaaacccaaaccaccaatcattgtgactcacgacagtccaaattccctcagagctaacgccgttgagatcagctcaggttgtgacatctgtgagactttatcggattttgcaagaaggaaacagagaggtctctgcattctcagtgccaatggttgtgtcaccaatgtgacattaaggcaaccagcttcatcaggagcaattgtcacattacacggacgttacgagatcctctcattgcttggatcaatcttgcctccaccagcaccacttggaataactggtctgaccatttacttagccggacctcaaggacaggttgttggtggaggagtggttggtgggctaatcgcatctggtcctgttgttctcatggctgcatctttcatgaatgctgtttttgatcgtcttcctatggatgatgatgaagctgcctctatgcagaaccagcagtactaccagaatggaagatcccgtcctttagatgacattcatggactgcctcaaaatctgctcactaatggaaactcggcttctgatatctactcttgggggcctgcgcagcgtgtcatgtcgaaaccttaatactactgctctaatctccacgtttcatcatatcaaatgccttaatcttattatctcatttaccttggaatcaaagataa

SEQ ID NO: 1930 - DNA, 774 bp, Arabidopsis thaliana
  G1667 DNA sequence used for BLAST
atggctggaggtacagctctaactccaacctctgtaggatccaagtctgttccaatgaggaaccatgaagcaacagagagaggcaacaccaacaacaacctgagagcattacccaaagccgtccaaccggtttcatcaatcgaaggagagatggctaagaggccacgtggcagacccgctggctccaagaacaaacccaaaccaccaatcattgtgactcacgacagtccaaattccctcagagctaacgccgttgagatcagctcaggttgtgacatctgtgagactttatcggattttgcaagaaggaaacagagaggtctctgcattctcagtgccaatggttgtgtcaccaatgtgacattaaggcaaccagcttcatcaggagcaattgtcacattacacggacgttacgagatcctctcattgcttggatcaatcttgcctccaccagcaccacttggaataactggtctgaccatttacttagccggacctcaaggacaggttgttggtggaggagtggttggtgggctaatcgcatctggtcctgttgttctcatggctgcatctttcatgaatgctgtttttgatcgtcttcctatggatgatgatgaagctgcctctatgcagaaccagcagtactaccagaatggaagatcccgtcctttagatgacattcatggactgcctcaaaatctgctcactaatggaaactcggcttctgatatctactcttgggggcctgcgcagcgtgtcatgtcgaaaccttaa

SEQ ID NO: 1931 - DNA, 1179 bp, Arabidopsis thaliana
  G1669 cDNA Sequence
atggtggtcgatgtagagagccgaaccgcgagcgtgacaggagagaagatggcggcgcgtggctgtgatgcgtgcatgaagagatcacgtgctagttggtactgtccagccgatgacgctttcctatgccaaagctgcgacgcctcgatccactcggctaaccatttagcgaaacggcacgaacgtgtccggttacaatcatcttcgccgacggagacggcagacaaaacgacgtcggtatggtacgaaggattcaggagaaaggcgagaacgcctaggagcaagagttgtgcgtttgagaagttgttgcaaatcgagtcaaacgatcctcttgttccggagcttggtggagacgaagatgatggctttttctcgttctcctccgtagaagaaaccgaggagagtctgaattgttgcgtgcctgttttcgatcctttctcagacatgctgattgatgatataaacggcttttgcttagttcctgatgaagtcaataacactactactaatggagaattaggagaagtcgagaaggcaatcatggacgatgaaggttttatggggttcgtgccattggatatggatcttgaggatctcactatggacgtggagagtttacttgaggaagaacaactttgcttgggattcaaggaaccaaacgatgttggagtcatcaaagaagagaataaagtagggtttgagattaattgtaaggatttgaagagggtgaaagatgaagatgaagaagaagaagaagccaagtgtgaaaatggaggatcaaaggatagtgatagagaagcatcaaatgataaagatagaaagacaagtttgtttctgagattagattatggagctgtgattagtgcttgggataatcacggttcgccgtggaaaaccggaatcaaaccggagtgcatgttgggagggaacacgtgtctgcctcatgttgtgggtgggtacgagaaattgatgtcgagcgacggatcggtgacacgtcagcaagggagagacggaggaggatcggacggggagagagaggcgagggttttgaggtacaaggagaagcggaggacgaggttgttctcaaagaaaataagatatgaggttcggaaacttaacgctgagcagagacctcgaatcaaaggtcgtttcgtgaagaggacgtcacttttgacgtga

SEQ ID NO: 1932 - protein, 392 aa, Arabidopsis thaliana
  G1669 Amino Acid Sequence
MVVDVESRTASVTGEKMAARGCDACMKRSRASWYCPADDAFLCQSCDASIHSANHLAKRHERVRLQSSSPTETADKTTSVWYEGFRRKARTPRSKSCAFEKLLQIESNDPLVPELGGDEDDGFFSFSSVEETEESLNCCVPVFDPFSDMLIDDINGFCLVPDEVNNTTTNGELGEVEKAIMDDEGFMGFVPLDMDLEDLTMDVESLLEEEQLCLGFKEPNDVGVIKEENKVGFEINCKDLKRVKDEDEEEEEAKCENGGSKDSDREASNDKDRKTSLFLRLDYGAVISAWDNHGSPWKTGIKPECMLGGNTCLPHVVGGYEKLMSSDGSVTRQQGRDGGGSDGEREARVLRYKEKRRTRLFSKKIRYEVRKLNAEQRPRIKGRFVKRTSLLT

SEQ ID NO: 1933 - DNA, 1309 bp, Arabidopsis thaliana
  G1669 DNA sequence used for BLAST
tcacgtcaaaagtgacgtcctcttcacgaaacgacctttgattcgaggtctctgctcagcgttaagtttccgaacctcatatcttattttctttgagaacaacctcgtcctccgcttctccttgtacctcaaaaccctcgcctctctctccccgtccgatcctcctccgtctctcccttgctgacgtgtcaccgatccgtcgctcgacatcaatttctcgtacccacccacaacatgaggcagacacgtgttccctcccaactggatcagtgaactttataacgttatttcgtcttttataatcaatatatatcagctcaaagtcaacggaactcgacactactaaagactaacatagagatgagagatatagctagagacaccaacttaccatgcactccggtttgattccggttttccacggcgaaccgtgattatcccaagcactaatcacagctccataatctaatctcagaaacaaacttgtctttctatctttatcatttgatgcttctctatcactatcctttgatcctccattttcacacttggcttcttcttcttcttcatcttcatctttcaccctcttcaaatccttacaattaatctcaaaccctactttattctcttctttgatgactccaacatcgtttggttccttgaatcccaagcaaagttgttcttcctcaagtaaactctccacgtccatagtgagatcctcaagatccatatccaatggcacgaaccccataaaaccttcatcgtccatgattgccttctcgacttctcctaattctccattagtagtagtgttattgacttcatcaggaactaagcaaaagccgtttatatcatcaatcagcatgtctgagaaaggatcgaaaacaggcacgcaacaattcagactctcctcggtttcttctacggaggagaacgagaaaaagccatcatcttcgtctccaccaagctccggaacaagaggatcgtttgactcgatttgcaacaacttctcaaacgcacaactcttgctcctaggcgttctcgcctttctcctgaatccttcgtaccataccgacgtcgttttgtctgccgtctccgtcggcgaagatgattgtaaccggacacgttcgtgccgtttcgctaaatggttagccgagtggatcgaggcgtcgcagctttggcataggaaagcgtcatcggctggacagtaccaactagcacgtgatctcttcatgcacgcatcacagccacgcgccgccatcttctctcctgtcacgctcgcggttcggctctctacatcgaccaccat

SEQ ID NO: 1934 - DNA, 1173 bp, Arabidopsis thaliana
  G1699 cDNA Sequence
atgaattcaccacaagaaatctccattctcttcttcttcatcatcttcttagactatgtatctgctcaatctcctcctcctcctaatctatacgcaacaagcgaccttttcaagccaagcttagctatcatcaccggagttttctccatcgtcttcactctcacctttgttctcctcgtctacgcgaaatgcttccacaatgacctccgatcagagaccgacagtgatggagaaagaatacgacatgatcgtctctggcaaggacttttcaatcggtcttcaagattctctggtcttgacaagaaagcaatcgaatctcttccctttttcagattctctgctttgaaaggattgaaacaagggcttgaatgttctgtttgtttgtctaaattcgaagatgttgagattcttaggcttttgcctaaatgcagacacgcttttcatattggttgtattgaccagtggcttgagcagcacgctacgtgtcctttgtgtagaaacagagtcaatattgaagacgacctctctgtgttgggtaatagcagcactagtcttaggatcttgaaccaatctgagacaagagaagaagactcgaggttggagatttacattgaacgcgaagaaggaactaatgacgggtcatcaagattcagcagtttccgaaagattctaaagaaatcgttgttgcttgagcgagaaggaaatgagaacatcgatgagaagaaacttatgcacaagttcaatcacaggatcgttgtttcggatgctgtgtttaagaaccgctggagtaatatcacttcatctgatttgacgtttttgacatcagaaatgctgaattcggtgtcaagcgacagattttcgtcggtggatcgagtgcatagaggtaacttgcgggacaaggaagatatggaaatgaaaagaatgttgattaagcacaaagactcatccagaagaacggtttctgagatcacgactgtttcaagagaaaaggcggttggaggaagctacagaggttcaaccgcgtccacttcgcagaattatgccgttactgcgaccacggaagaaagaagacggcggttatggctgccgatcgctagaagaacggctcagtggtttgttaacagagagaaaagtaatgacctaaacacgacacgccaaaatcttaatgtatag

SEQ ID NO: 1935 - protein, 390 aa, Arabidopsis thaliana
  G1699 Amino Acid Sequence
MNSPQEISILFFFIIFLDYVSAQSPPPPNLYATSDLFKPSLAIITGVFSIVFTLTFVLLVYAKCFHNDLRSETDSDGERIRHDRLWQGLFNRSSRFSGLDKKAIESLPFFRFSALKGLKQGLECSVCLSKFEDVEILRLLPKCRHAFHIGCIDQWLEQHATCPLCRNRVNIEDDLSVLGNSSTSLRILNQSETREEDSRLEIYIEREEGTNDGSSRFSSFRKILKKSLLLEREGNENIDEKKLMHKFNHRIVVSDAVFKNRWSNITSSDLTFLTSEMLNSVSSDRFSSVDRVHRGNLRDKEDMEMKRMLIKHKDSSRRTVSEITTVSREKAVGGSYRGSTASTSQNYAVTATTEERRRRLWLPIARRTAQWFVNREKSNDLNTTRQNLNV

SEQ ID NO: 1936 - DNA, 1173 bp, Arabidopsis thaliana; identical to SEQ ID NO: 1934
  G1699 Genomic Sequence

SEQ ID NO: 1937 - DNA, 131 bp, Arabidopsis thaliana
  G1699 DNA sequence used for BLAST
tttctacacaaaggacacgtagcgtgctgctcaagccactggtcaatacaaccaatatgaaaagcgtgtctgcatttaggcaaaagcctaagaatctcaacatcttcgaatttagacaaacaaacagaaca

SEQ ID NO: 1938 - DNA, 1131 bp, Arabidopsis thaliana
  G1705 cDNA Sequence
atgtcttgggttcgattcacaattgagcaaaaagatgggaactttgcgtacccaccaccgttttacaaagacccaattctttctccgccgtctcctccaccaccgtcgtccggtaacagaatcagtccggcggttttgtttgtaattgtgattctagctgtcttgttcttcatttctgggcttcttcatttgctcgtcaggtttcttattaagcatccttctgctactgcttcttcaaggtctaatagattcccagagatctcaactagtgatgctcttcaaagacagcttcaacagctttttcatttgaatgattctggtcttgatcaagcttttatcgatgctttacctgtttttcactacaaggagattgttggtagtgctggtggtggtggtggtaatggtgctgctcaagagccgtttgattgcgcggtttgtctctgtgagttctctgagaaagataagctgaggttgttgccaatgtgtagccatgcttttcatttgaactgtattgatacttggcttcagtcaaattcgacttgtcctctttgtcgtggtactctcttttcccctggtttctcaatggagaacccgatgtttgatttcgatgatataagagaagacgaagagggtgtgaccgagaatggaagtcagaaaactatggagattcaagaaatcgttgtggagaaaggtgttttaccggttagattggggaaatttaagaggcttgacaatgttggtaatggccaaggtcaggatgttgttgccggaggagagactagtagtagtaatttggatgcaaggagatgtttctcaatgggttcgtatcagtatatactcggtaactcggaacttaaagtcccgtttgccaacgacagactgccgcgtttgaaacctcaggacaaagaatctgagcagacagggaattcatcatcagaagacaataaaaagatcaatactgtggctaaaggagagagcttttcggtttcgaagatttggttgtggcctaagaaagataagttctcttcagatgctcaaagaaggttgccttcttcatcacttaacgttgatgatcttccgaaacttccatggatggaagaacataagaagctggagaacgacggaaggtag

SEQ ID NO: 1939 - protein, 376 aa, Arabidopsis thaliana
  G1705 Amino Acid Sequence
MSWVRFTIEQKDGNFAYPPPFYKDPILSPPSPPPPSSGNRISPAVLFVIVILAVLFFISGLLHLLVRFLIKHPSATASSRSNRFPEISTSDALQRQLQQLFHLNDSGLDQAFIDALPVFHYKEIVGSAGGGGGNGAAQEPFDCAVCLCEFSEKDKLRLLPMCSHAFHLNCIDTWLQSNSTCPLCRGTLFSPGFSMENPMFDFDDIREDEEGVTENGSQKTMEIQEIVVEKGVLPVRLGKFKRLDNVGNGQGQDVVAGGETSSSNLDARRCFSMGSYQYILGNSELKVPFANDRLPRLKPQDKESEQTGNSSSEDNKKINTVAKGESFSVSKIWLWPKKDKFSSDAQRRLPSSSLNVDDLPKLPWMEEHKKLENDGR

SEQ ID NO: 1940 - DNA, 1131 bp, Arabidopsis thaliana; identical to SEQ ID NO: 1938
  G1705 Genomic Sequence

SEQ ID NO: 1941 - DNA, 211 bp, Arabidopsis thaliana
  G1705 DNA sequence used for BLAST
tgctttacctgtttttcactacaaggagattgttggtagtgctggtggtggtggtggtaatggtgctgctcaagagccgtttgattgcgcggtttgtctctgtgagttctctgagaaagataagctgaggttgttgccaatgtgtagccatgcttttcatttgaactgtattgatacttggcttcagtcaaattcgacttgtcctctttgt

SEQ ID NO: 1942 - DNA, 675 bp, Arabidopsis thaliana
  G1742 cDNA Sequence
atggctttctatgtaaacgataacgtagacaacgtgatcgatgtcaagcggatctacaacgactacgacggagaactacgaaagagccaaaaattgtttttcgatttcaaagtgcattacactcgtgccgaagaagaagatgatgacgttgaagaagaagaagattttcccgattttgacaatcttcaaactctaacccttgagcaaacacacgagtttgatcgagattggttgtttggtggagacggtgatcattcactagccatcgtctatcacattctagattcgctccaagtccctccttattctgctattgttaacactcttgctgatgagattaaggatttgaagaaagatggtgcgaaagacgtggagagggtacaagtaaagataggtgttactgtctcgaggtttcccggtgaagatgatcacgtagatgtgcaagtgcaacttgcggttgctccagcgaacgatgaggcggtggagatgcacttggagacgcttgttgttgagaatgaaggctattgtgtgatatgcatggataatatccgagttgggtcagatgtggaagcgggtcgaatgccgtgttcgcatgtgtttcatcgtacttgtggagaggaatggcttaggaacagtgggatttgtccggtgtgtcgtgccctgtttccggcttaa

SEQ ID NO: 1943 - protein, 224 aa, Arabidopsis thaliana
  G1742 Amino Acid Sequence
MAFYVNDNVDNVIDVKRIYNDYDGELRKSQKLFFDFKVHYTRAEEEDDDVEEEEDFPDFDNLQTLTLEQTHEFDRDWLFGGDGDHSLAIVYHILDSLQVPPYSAIVNTLADEIKDLKKDGAKDVERVQVKIGVTVSRFPGEDDHVDVQVQLAVAPANDEAVEMHLETLVVENEGYCVICMDNIRVGSDVEAGRMPCSHVFHRTCGEEWLRNSGICPVCRALFPA

SEQ ID NO: 1944 - DNA, 675 bp, Arabidopsis thaliana
  G1742 Genomic Sequence
ttaagccggaaacagggcacgacacaccggacaaatcccactgttcctaagccattcctctccacaagtacgatgaaacacatgcgaacacggcattcgacccgcttccacatctgacccaactcggatattatccatgcatatcacacaatagccttcattctcaacaacaagcgtctccaagtgcatctccaccgcctcatcgttcgctggagcaaccgcaagttgcacttgcacatctacgtgatcatcttcaccgggaaacctcgagacagtaacacctatctttacttgtaccctctccacgtctttcgcaccatctttcttcaaatccttaatctcatcagcaagagtgttaacaatagcagaataaggagggacttggagcgaatctagaatgtgatagacgatggctagtgaatgatcaccgtctccaccaaacaaccaatctcgatcaaactcgtgtgtttgctcaagggttagagtttgaagattgtcaaaatcgggaaaatcttcttcttcttcaacgtcatcatcttcttcttcggcacgagtgtaatgcactttgaaatcgaaaaacaatttttggctctttcgtagttctccgtcgtagtcgttgtagatccgcttgacatcgatcacgttgtctacgttatcgtttacatagaaagccat

SEQ ID NO: 1945 - DNA, 201 bp, Arabidopsis thaliana
  G1742 DNA sequence used for BLAST
acaaaactaatacaaaaggggttttaaagttttaagccggaaacagggcacgacacaccggacaaatcccactgttcctaagccattcctctccacaagtacgatgaaacacatgcgaacacggcattcgacccgcttccacatctgacccaactcggatattatccatgcatatcacacaatagccttcattctcaacaa

SEQ ID NO: 1946 - DNA, 1944 bp, Arabidopsis thaliana
  G1773 Genomic Sequence
atgagttcttcagatcgtgacatcatcgatatcgaatcaggagaagaagatttgtatagcgatggtggtaacgacatcatcgatatcgaatcaggagaggaggatttgtacagcgatggtggtaacgtatccgatgactacaaccctgtggacgacacaattagtcgatctgagaaaagttacgttgttgttaaggaagaagacattcttaagcttcaaagagacgatatcgaacaagtttcgacggttctctctgtaagccaagtggaatcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagggtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatacgcggttgaatttggtgtaaatggaagtagtagttacgatgtttcttgtttgtgttcgtataagttttgctggaattgctgtgaagacgctcactctcctgtggattgtgaaacagtgtcaaagtggttactaaagaacaaggatgagtcggagaacatgaattggatacttgctaagacaaagccttgtcctaaatgcaagcgtcctattgagaagaacactggatgtaaccatatgtcatgctcagctccatgtagacattatttttgttgggcatgccttcaaccattgagcgatcacaaggcttgcaacgcgtttaaagcagacaatgaggatgaaactaagagaaaaagggctaaagatgcgatcgatagatacacgcatttttatgaaagatgggcattcaatcaatcctcgaggcttaaagctatgagtgatttggagaaatggcaatcggtggagcttaagcagcttagtgacattcagagcacaccagaaactcagctcagtttcaccgtagatgcatggcttcaggttagtaaaagtaacatttacaagaccattgaaaatgtttgtggaaacgacggaacataatggaattactaccatagtagatatataataaacgacaagctttcttgaagacgattttatgagtaacttatcattgatctgaactgatgaatagatagattacaaaaaaagtgtgtataattttcaaactggcaaaaatcatcccaccattatgctagccaccaatgagattctaagttagattttgttacttacattgtaacagcggaacataatctgtagtagaaaaaactagaaaagctttattaaattgaaaaatcatcttaatgacggttaactttccgaaatggtgaaaccattccaccattatgcatgagaactaccaattagactctaagttagttacggcattaattatattctcattccaccattatgcatgagaactaccaattagactctaagttagttacgacattatattaattcttgttgacatgtacttgattttactgttacagatcatcgagtgtaggagggtcttgaaatggacctatgcatatggatactacatacttagtcaagagcgcaacaagcgagtatttgcaaggtcagtttttggtacggaaacacttaatttgtgtgtaatcttaatttttccattaattgtagcagaactttttcgttgtcttgttgttcagctga

SEQ ID NO: 1947 - DNA, 1944 bp, Arabidopsis thaliana
  G1773 DNA sequence used for BLAST
tcagctgaacaacaagacaacgaaaaagttctgctacaattaatggaaaaattaagattacacacaaattaagtgtttccgtaccaaaaactgaccttgcaaatactcgcttgttgcgctcttgactaagtatgtagtatccatatgcataggtccatttcaagaccctcctacactcgatgatctgtaacagtaaaatcaagtacatgtcaacaagaattaatataatgtcgtaactaacttagagtctaattggtagttctcatgcataatggtggaatgagaatataattaatgccgtaactaacttagagtctaattggtagttctcatgcataatggtggaatggtttcaccatttcggaaagttaaccgtcattaagatgatttttcaatttaataaagcttttctagttttttctactacagattatgttccgctgttacaatgtaagtaacaaaatctaacttagaatctcattggtggctagcataatggtgggatgatttttgccagtttgaaaattatacacactttttttgtaatctatctattcatcagttcagatcaatgataagttactcataaaatcgtcttcaagaaagcttgtcgtttattatatatctactatggtagtaattccattatgttccgtcgtttccacaaacattttcaatggtcttgtaaatgttacttttactaacctgaagccatgcatctacggtgaaactgagctgagtttctggtgtgctctgaatgtcactaagctgcttaagctccaccgattgccatttctccaaatcactcatagctttaagcctcgaggattgattgaatgcccatctttcataaaaatgcgtgtatctatcgatcgcatctttagccctttttctcttagtttcatcctcattgtctgctttaaacgcgttgcaagccttgtgatcgctcaatggttgaaggcatgcccaacaaaaataatgtctacatggagctgagcatgacatatggttacatccagtgttcttctcaataggacgcttgcatttaggacaaggctttgtcttagcaagtatccaattcatgttctccgactcatccttgttctttagtaaccactttgacactgtttcacaatccacaggagagtgagcgtcttcacagcaattccagcaaaacttatacgaacacaaacaagaaacatcgtaactactacttccatttacaccaaattcaaccgcgtattcgcatcccggtgatggacaccatttcatcttcttcccgtcttcgacataagacctaagaaaatatctataatacttgtccttatctttcttctcagtaacctcatcgatcatgtcttgaccaacaacagcgtaacaagaaggttcgggacatttaacccttaaacatcccggaccgtcttcgattttcgtagtgatgtaaccagtccagcaggtcttgcaataaggatgaccacaagaaaccctagcaatttcctttcgagtgtatgattcaaagcaaattccacattgaatatccacttctgtaccattaacatcaacgacaggctcctttaatataccaacggttttacggattctctcttcgtccgtaaaccattcatcttcgagtttactaacacaccaatgatagtgaagaagcagaacaatcgattccacttggcttacagagagaaccgtcgaaacttgttcgatatcgtctctttgaagcttaagaatgtcttcttccttaacaacaacgtaacttttctcagatcgactaattgtgtcgtccacagggttgtagtcatcggatacgttaccaccatcgctgtacaaatcctcctctcctgattcgatatcgatgatgtcgttaccaccatcgctatacaaatcttcttctcctgattcgatatcgatgatgtcacgatctgaagaactcat

SEQ ID NO: 1948 - DNA, 705 bp, Arabidopsis thaliana
  G1785 cDNA Sequence
atgaaaaaaaattatcaaaagaagaatataaaggtggtgagcacaagcaaatatttgaagaaaagtgacatcgacaaagtaaactggacagaatctgaggacataaaattgaaagagataatggcgcttggacccaaaaacaaatggacaaaggtcgcaaaaaaattcgaaggaagaacaggaaaacaatgcagagagaggtggtataaccatgctcgtcctaacattaagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataa

SEQ ID NO: 1949 - protein, 234 aa, Arabidopsis thaliana
  G1785 Amino Acid Sequence
MKKNYQKKNIKVVSTSKYLKKSDIDKVNWTESEDIKLKEIMALGPKNKWTKVAKKFEGRTGKQCRERWYNHARPNIKKTAWSEEEDQILIEAHKVLGTKWVEIAQQLPGRSDNNIKNHWNTTKRRVQNKRGGTVNPVGNNILENYIRCITINNEDFLKTDGSYGEPTNIESDDDSKDMLYGEMNLSLETITTQTTKPLTNASTTSPYVQMPEDNYTMEDCESLEDILELLRWWE

SEQ ID NO: 1950 - DNA, 1257 bp, Arabidopsis thaliana
  G1785 Genomic Sequence
atgaaaaaaaattatcaaaagaagaatataaaggtggtgagcacaagcaaatatttgaagaaaagtgacatcgacaaagtaaactggacagaatctgaggacatgtaagtcttcatatttttttcattctcattaaaacttaaaactattattatatttcatccttgggaattcttatataattattttttattgtaaaccttttatttattttttgaggatgtgaaaatattttgtaatatatatagaaaattgaaagagataatggcgcttggacccaaaaacaaatggacaaaggtcgcaaaaaaattcgaaggaagaacaggaaaacaatgcagagagaggtggtataaccatgctcgtcctaacattaaggtgttcttttctttcatctccctacattcttattttcataatttaatatagatgatcatcacaacttatatgtgtgtatatataaatgttataaacaacaattgcattatcatgattttttgtttattattaatcatgtatatttttgtgtgaaagcaactaggtacttacaatgtgcacatgcatatgtataatgtatagattgcaattcatatagtttaatagtggtgtggctaacattttaatcacaacagtttcaaagggttattaaaacgtgcatctttttagtttgtatcttgcttctatcaataaaaatagtcatagacatacaataataagagcatgattaattatttatgtatatgtaaatgacataattacatataaataattaatatgtgatttcagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataa

SEQ ID NO: 1951 - DNA, 1257 bp, Arabidopsis thaliana; identical to SEQ ID NO: 1950
  G1785 DNA sequence used for BLAST

SEQ ID NO: 1952 - DNA, 887 bp, Arabidopsis thaliana
  G1787 Genomic Sequence
atggataatgttaaaccctacaccgatccaatgtcggaagaagaacaaaaccctgatccaatgtcggaagaaagagaacaaaacccgaatccgatgatctacctatgtcccgatctagtggaagaaatcgtccttggattgccgttgaattcaatcctcagattcaaaacggtctcaaaacaatggagatcaatccttggattgtgagatttttgatgtcaatattggtgaatggcggagatcgaggagcccccctccttattgggtggatcccagaaggaagtctgcgtgtgttcagggctccatctactggttaaatgtcaaacctttccaggtactagctttggatcttcacacacaagagttccataatgttcgctcaagaccaactcacgcaacttatgccgaccaacttgtcaaccttgatgaccgtctagccatagcctaatcgtttttgcatcctccttggatactatggatatggaccatggatgttctaaaagatgatggatggaccaaggcttactccatagatttatcctcctgtagagatcttaccgtggaaagtgcattttaggccggtggcggtttctaagcatggaaatgtttacttgcatgacaatgaaaagaggttgttgaaatactatccaaagaccaacctccttcgttgcatctctaaagacacttgggtcatatcccctatggttgagaatgtgcttccacttcggcctctaggctctattcccaagacattcggctacggatccatatctcaggagcttaaccacatgccgggatcgaggatgtccaaatttcttagcagaatcccaactatactgtttacaaccactctagtgtctcaagttgtttaccgctatttgtcttga

SEQ ID NO: 1953 - DNA, 887 bp, Arabidopsis thaliana; identical to SEQ ID NO: 1952
  G1787 DNA sequence used for BLAST

SEQ ID NO: 1954 - DNA, 1957 bp, Arabidopsis thaliana
  G1807 Genomic Sequence
atgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggtacaaatattgaatcttgactaacattaccggtttataatcaaatattctgatgtttaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcaggtgcgttgtttacaatgttataaaagcgcctagattggtcaatttttgttttgttctaacgatcttagttactgcattatccagcgcgatatgatggggttgacaaatcagaacaatgagcttaagttccggcttcaagcaatggagcaacaagcgcgtcttcgcgatggtatacatttctcttcacattgtatcaaatttacgatattattaacatgactttaacaaaaaatggaaccagatcctatatgctttaaaaaaatctccatttttgcgcttaacgaatgtgaaatgacgatttttttcccccgctttgcagctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatag

SEQ ID NO: 1955 - DNA, 1957 bp, Arabidopsis thaliana
  G1807 DNA sequence used for BLAST
ctattcatttgattcagattttgttgccatggttccattctggtggttctgctgatgagactgttgctgcatctgttgtggctgctgtcttaactggctgatgttgagttgctggaacatctcagcgttgagtgattgcatctttgatctctctgattcgttctgactgctctcaccgattgccagtttcagtcgctggacttctccattcagtgcttcgttcagagctgcaaagcgggggaaaaaaatcgtcatttcacattcgttaagcgcaaaaatggagatttttttaaagcatataggatctggttccattttttgttaaagtcatgttaataatatcgtaaatttgatacaatgtgaagagaaatgtataccatcgcgaagacgcgcttgttgctccattgcttgaagccggaacttaagctcattgttctgatttgtcaaccccatcatatcgcgctggataatgcagtaactaagatcgttagaacaaaacaaaaattgaccaatctaggcgcttttataacattgtaaacaacgcacctgcaaaagtgtgagctgagcagacaatgtggtagcctcggtctgaagagtctgcactttgtgttccaattctactatgtaccgcatcttcctctcctttgaccgtgctgcggattgacggttcgctaagattctgaaaagaggatcattccttaaacatcagaatatttgattataaaccggtaatgttagtcaagattcaatatttgtaccttttgacacgtttagggtcagacatggccatctctgctagtttatcatttgccatgatcttcttcatttccgctgcagtaaactcaccgttattgaactcgatgctaaaagcagcacccgagttcccatcaaccgaattggtaggggaaactttccttgacatagatccaggagaaggaggcggctttagagattcatcaccaaaagacaacttctccatgaaacaactgtccactgaaacactcctgtaatgtctggtggtaggagcaatatctcctccagccgctcttctcttcacgctctctctcttttcaccagaagaattcatattattattggcactctcattgacactgctgctctctccttccgtatcactaccgttagtcttggtcccgcttgctctgctgctctccatatcatccctattctcattaccgttcttgctatcatcagcttcagaggagttcaacacatcaatgttttcaagattcatatatgctgagaagagatcatccatagcttctctctctccgacaccttccctttcgcagctcgattccttcttcacaaaaggattagactttgaccaatcagcacactccccaccagaaaaagacctctccaatggtctcggagggatcaaaggcatcgaattaaacccactggggatatcactgttggagcgtctatgagactttctcggaggtaaactctcaccgactctcaaggagctagaagaggtcgaattacacctcgtgaacggcgatggaggcaacgaatggttgctgttaaacacgccggaatctctatcctccattgaaacatcgtgatctcgaaacggagaagggcttaacggaggtaaggagtcaaaagagaagaaagagttgggctgtgacattgaccgtgaatgattagctcctcccgggttaaaattatgcgaaccgggttgtcgggtggtcgggatctgagaaaacggagaagtcggtgggattaagttggggtgcgacggaggaacaccgattcgtttgccactgtcactgaaaggcttggagaattgaggagctgatgagcggatgaaattagggtttaaatcgagctgagaaatgggatttttgggaatggaagaagaagtagtgccgaaagatgaatgaagtctctggatcatatcactgttacacttctctgtatcacccat

SEQ ID NO: 1956 - DNA, 668 bp, Arabidopsis thaliana
  G1836 cDNA Sequence
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 1957 - protein, 187 aa, Arabidopsis thaliana
  G1836 Amino Acid Sequence
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 1958 - DNA, 564 bp, Arabidopsis thaliana
  G1836 Genomic Sequence
ttagtttccgtcgtcacctccttttttcccacgcgcttcttcctcctcaccagacaccgaggtccaagctccaggccatgcctgcatttgtggttgtggttggtggattccaagactacaacaaacaggagttccaattaccattcctggaggcagctctccatcgtcaataggtggcatggccacaggatcagcagcggcggcaacagactctctctttacctcaatgtcatcatcaagcaagaaatcaaagataacagtttgagccactgcggcatcgacattagatttctgtagcgtgactcgtttgctttcctgagcatggagccacgaacgcatcgtgagatccatgataaacatctcacatgctttcgagaggaggattggagcctcactagctatcatagtcacatccggatcatacttcataatcttcttgatacgagttataggaaggtcgtgatttttgaaatctaagttaccttccatctcttttgaccagaaactcttcagttgctcgttacctttcggtggcagctggttgttgccgttgttgttctccat

SEQ ID NO: 1959 - DNA, 564 bp, Arabidopsis thaliana; identical to SEQ ID NO: 1958
  G1836 DNA sequence used for BLAST

SEQ ID NO: 1960 - DNA, 717 bp, Arabidopsis thaliana
  G1894 cDNA Sequence
atgaagatacaatgtgatgtgtgtgagaaagctccggccacgcttatatgttgtgctgatgaagctgctctctgcgctaaatgtgacgttgaggttcatgctgctaataaactcgctagcaaacaccaacgcctttttcttgactctctctcaactaaattccctccctgcgacatctgccttgagaaggcagctttcatattctgtgtagaggatagggctctgctctgcagagattgcgatgaggcgacccatgcgccaaatactcgctctgctaatcaccagaggttcttagccactggaatccgagttgctcttagttccactagttgcaatcaagaagtggaaaagaatcactttgacccatctaatcagcagagtctctctaaaccgccaactcagcaacccgctgctccatctcctttgtgggctaccgatgaattcttcagctactctgatcttgactgcagtaataaggagaaagagcaactcgatctcggggagctggattggcttgcagagatgggtctgtttggtgaccagcctgatcaagaggctctaccggtagccgaagttcccgagctttccttttcacatttggctcatgctcattcctacaacagacctatgaagtccaatgtacccaacaagaagcagaggcttgagtaccggtatgatgatgaagaagagcacttcctagtccccgacctaggctaa

SEQ ID NO: 1961 - protein, 238 aa, Arabidopsis thaliana
  G1894 Amino Acid Sequence
MKIQCDVCEKAPATLICCADEAALCAKCDVEVHAANKLASKHQRLFLDSLSTKFPPCDICLEKAAFIFCVEDRALLCRDCDEATHAPNTRSANHQRFLATGIRVALSSTSCNQEVEKNHFDPSNQQSLSKPPTQQPAAPSPLWATDEFFSYSDLDCSNKEKEQLDLGELDWLAEMGLFGDQPDQEALPVAEVPELSFSHLAHAHSYNRPMKSNVPNKKQRLEYRYDDEEEHFLVPDLG

SEQ ID NO: 1962 - DNA, 1153 bp, Arabidopsis thaliana
  G1894 DNA sequence used for BLAST
ttagcctaggtcggggactaggaagtgctcttcttcatcatcataccggtactcaagcctctgcttcttgttgggtacattggacttcataggtctgttgtaggaatgagcatgagccaaatgtgaaaaggaaagctcgggaacttcggctaccggtagagcctcttgatcaggctggtcaccaaacagacccatctctgcaagccaatccagctccccgagatcgagttgctctttctcctaatgtacaacaagtgatttatatagttgtcaaaacaagttacaaaccaggatatttgagtattcatcagtttggtaaaccagttctcaccttattactgcagtcaagatcagagtagctgaagaattcatcggtagcccacaaaggagatggagcagcgggttgctgagttggcggtttagagagactctgctgattagatgggtcaaagtgattcttttccacttcttgattgcaactagtggaactaagagcaactcggattccagtggctaagaacctctggtgattagcagagcgagtatttggcgcatgggtcgcctcatcgcaatctctgcagagcagagccctatcctctacacagaatatgaaagctgccttctcctgcaagtcaacaaagatgaacacaagaaagagatttactacataagcaactttgagcatgtttttcttgagatcccattaagaatatctaccaaagttggatctacatatccaaccttagcaaactaaaaacatccaaaaacaaacaaatttcctgagatcccactaaaacctttactaaacttaaatctaaaaccttaatctatgttataaagctaagaacttctcgataattatacttaaagaatctaccaagaacagctcaatcaaaagataccctcaaaacaaataaagatctctgcagatacgaatagagacaaaagagagaagaggaggtattcttacaaggcagatgtcgcagggagggaatttagttgagagagagtcaagaaaaaggcgttggtgtttgctagcgagtttattagcagcatgaacctcaacgtcacatttagcgcagagagcagcttcatcagcacaacatataagcgtggccggagctttctcacacacatcacattgtatcttcat

SEQ ID NO: 1963 - DNA, 897 bp, Arabidopsis thaliana
  G1900 cDNA Sequence
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 1964 - protein, 298 aa, Arabidopsis thaliana
  G1900 Amino Acid Sequence
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 1965 - DNA, 1487 bp, Arabidopsis thaliana
  G1900 DNA sequence used for BLAST
catctgctcatggaaattgattgatcttgataacgcagcagggtttgcacaaagaacaagtgaggtctctgtttcttctttgttactgagcttaacctctttcttcgaaccaaacccattgaacataacttcgttcttgatcccaagtgttgtccatatcgaactctttgcagcttcattaggatcatcaattctcaaagtctttggaaccaatacagatccattcctctgtttttgcttcaccgtctcgtcttcgtctctcgaatgcttaccaagagtagaagtaggacttgaacttaccggagaagacaacactggcatgctccaataagggtaaaccgggtaaaacgcaggattccacgtgtacggccacgaaactcccggaaaacaattcaaaccgttcgaagtgttgttattagagcgctcgtcattgttctctatcctagcaactagcttttgattaccaaacctattactcgagaccttttgatcatctccgaggctgaaactaaggaccggaccatttgtttcggagatagtcacatggtggtaatgtgaagttggtgagttgttcttgttcttgcgccgtcctgctccgattggaacacttctcatggtcccacctgaggtccaatatctctgacaagctttacaaaaatggcgaggttggtttacgttgtagttgttgtagtaacagaacttagtctccatgctgttgcatcttggacatggaagaatcttggttggtttctttagggttttgtctttctccgattgatcagttaatgtcttgttttggttctgatgcaagacaatgaaatcggattattagggacggatgatgaataaagaaagaataacatttttgaagcatgttaaacagaaatgaatttaaaactttgtattataatgagtatgattctcaagaagaaggttctagatgaaattttggtggaggaaaaagtcttttaaagaacacgctttagttagaagtctaaattcgctcacctttattggtttcagtgtgtatactataaagcaacctttttcactaaaaaatatgattactttatggagaaacgaatatgctttttcgtttcatgaaaagtcatcaaaccaaattgcaacctctggttcaccaacagagaactagagttttaattaaacagatggtttaagtgtattttcttaggaattctccaaaaagtttaccaattcatcaactatgaatataaaacgataccaaaaaaagaaaacagttgcctttgatgggaaaatgaacaaaaactcaaatacccttttcaaaacaccaaaactcattttctctatacttgtatataacaaaacatactcagccctttcagaaacaaaaaagtagacataataatgagtaccttttcttcttcttcatcagcaacctctaaaaccgtcgggaaaggaattttcataccaaagagctttatcgcaggatctttagtttccagcat

SEQ ID NO: 1966 - DNA, 585 bp, Arabidopsis thaliana
  G1901 cDNA Sequence
atgcaggatctgacgtcagcagcagcgtattatcatcagtcgatgatgatgacgacggcgaaacagaaccaaccagagttaccagaacaagaacagctaaagtgtcctcgctgtgactcacctaacactaaattctgttactacaacaattacaatctgtcacagccccgtcacttttgcaaaaactgtcgtcgttactggactaaaggcggtgctcttcgtaacatccccgtcggtggtggaactcggaaaagcaacaaacgatccggttcttctccgtctagtaatctcaagaaccaaaccgtcgctgagaaacctgatcatcatgggtccgggtcagaagaaaaagaagagagagtttcgggtcaagaaatgaatccgacccggatgttatacgggttaccagttggagatccgaatggtgcgagttttagttcgttgttggcgtcgaatatgcagatgggtgggcttgtttacgagtccgggtcgcgttggttaccaggtatggatttgggtttgggttcggtacggaggagtgatgacacgtggactgacttagctatgaacagaatggagaagaattga

SEQ ID NO: 1967 - protein, 194 aa, Arabidopsis thaliana
  G1901 Amino Acid Sequence
MQDLTSAAAYYHQSMMMTTAKQNQPELPEQEQLKCPRCDSPNTKFCYYNNYNLSQPRHFCKNCRRYWTKGGALRNIPVGGGTRKSNKRSGSSPSSNLKNQTVAEKPDHHGSGSEEKEERVSGQEMNPTRMLYGLPVGDPNGASFSSLLASNMQMGGLVYESGSRWLPGMDLGLGSVRRSDDTWTDLAMNRMEKN

SEQ ID NO: 1968 - DNA, 584 bp, Arabidopsis thaliana
  G1901 DNA sequence used for BLAST
gttccaccaccgacggggatgttacgaagagcaccgcctttagtccagtaacgacgacagtttttgcaaaagtgacggggctgtgacagattgtaattgttgtagtaacagaatttagtgttaggtgagtcacagcgaggacactttagctgttcttgttctggtaactctggttggttctgtttcgccgtcgtcatcatcatcgactgatgataatacgctgctgctgacgtcagatcctgcatttttcttttccccgggaaaatttctgactctgcacacaatctttgatcggaaaaagtttgtttcttacgtgaaaatattggtttatgaagagagagagacctttgatggaatcttttttggtgtgggaagttgcaagttataggagaaggaggaagagagataaagagtggagttatttggtggtgggtttattttcatttataaccacaaaatgacaattttttcaagcctttctagatttttttttgtgttttgggtatatatatggagagaaaagagagtttgtgttgatgaagatttcaagatttatttcttgttgacctttgttttctattttg

SEQ ID NO: 1969 - DNA, 1200 bp, Arabidopsis thaliana
  G1903 cDNA Sequence
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 1970 - protein, 399 aa, Arabidopsis thaliana
  G1903 Amino Acid Sequence
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 1971 - DNA, 1460 bp, Arabidopsis thaliana
  G1903 DNA sequence used for BLAST
ttattgttgcatgctctccctgaagttcatagctctagacatcgctgcagggtttgcttgtagactgtgagaagtttcggagaccaagctacttctgttgctgtttccctttgtgtcaaatccattgaacaaactgaatccttgcgtttttttctcgggttttgtcggtaacttagaccacacagcgctcttactagcttcgatattcattctaagagattctgagaccaatcttgctcttgtagtagttattgttgtattagtatcattgattcttccttcagtttgatctcttgaccgttttcctaaacatgatgaagtctctgaggtagggtatatcggaaccgtgcatccccagtagaaggggacagggtagaaactagcgttaggacccgttggactccattggtaaggccaaggagaagaattattaggtaacattacttgcggaggaagaaacccttggtagcttttattttcttgagaaactgaatcagcacttatctttgctgtatcacctgactgatgcttaccagtctctgtaaccgaagactccgaagaaccgaaactaaggatcgtccccgagttattattatcacaatcctcagaagtgacttgcaagtaatggtttgaagaaggccatcctttgttcttgcgacgacctgagccaacaggaacgttcctcatagatccaccagctgtccaatacctctgacagttcctgcagaagtaacgtggctggttcacgttgtagttgttgtaataacagaatttggtgtttgcgctttcacatctaggacatggaataagcttgtccggtttcttgagagccgttgatttctctcctgatgtagtacttgtggtagttgttgttgtgatctcgctctgttgatcacagttgttcttggaacttcttggtgatgaaatctcagatactgcttttggtggttcgtttagatcggataatatatatggatctttgaatttgttactctcttgctcactttttttaaccggaacctgaattttttgtagaattttgattagaattagcaaagagatataaacagtcaagcaaacattaatttttttagcctttataactcataacagagagagaaagtctcaaattttagggttaaaaattcagatcgagatcgacccatttgtagattccctcagccaagaaacttttatatattcatctcaaaatcataaagttcgtttatagattaattaacacataacaaaaaaaagaggttaagattctcatgacataccctgattggtccaatagttggagaacaagaagatgaagaagaagacgaatcctccttgcttggatcagaagaaacatcgtgaacaggggacaacgacgacggatcataacaattcacatctaaaagagatgtgattgtcctcccaaacaactttatctccgtatctctagatttagacat

SEQ ID NO: 1972 - DNA, 294 bp, Arabidopsis thaliana
  G1911 cDNA Sequence
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 1973 - protein, 97 aa, Arabidopsis thaliana
  G1911 Amino Acid Sequence
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 1974 - DNA, 294 bp, Arabidopsis thaliana
  G1911 Genomic Sequence
ttaggacaatacataccttttttcctcctgactaagcctgccattagtgcagcctccactagtcctgtagtttgggaatggaacatgaccgttctctatgctgttgatgtcttgcactaagagttcgtagtgtctctttacctcctctgttgtttttccacccacgactttggcaacattttgccaacggttaggagtgtcctggtcataggttgctagagcctgctcaaaggctttgttctgcttagcagtccacgagccagagctctgagaagacattgagcttgatgccat

SEQ ID NO: 1975 - DNA, 294 bp, Arabidopsis thaliana; identical to SEQ ID NO: 1974
  G1911 DNA sequence used for BLAST

SEQ ID NO: 1976 - DNA, 885 bp, Arabidopsis thaliana
  G1917 cDNA Sequence
atgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatga

SEQ ID NO: 1977 - protein, 294 aa, Arabidopsis thaliana
  G1917 Amino Acid Sequence
MQTPYTTSTQGQYCHSCGMFHHHSQSCCYNNNNNSNAGSYSMVFSMQNGGVFEQNGEDYHHSSSLVDCTLSLGTPSTRLCEEDEKRRRSTSSGASSCISNFWDLIHTKNNNSKTAPYNNVPSFSANKPSRGCSGGGGGGGGGGGGDSLLARRCANCDTTSTPLWRNGPRGPKSLCNACGIRFKKEERRTTAATGNTVVGAAPVQTDQYGHHNSGYNNYHAATNNNNNNGTPWAHHHSTQRVPCNYPANEIRFMDDYGSGVANNVESDGAHGGVPFLSWRLNVADRASLVHDFTR

SEQ ID NO: 1978 - DNA, 1255 bp, Arabidopsis thaliana
  G1917 DNA sequence used for BLAST
atgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaaggtgacttatttattttaatttttattaaaatgcaacttcttttaatcaacacatgaaatgaagatttacaataaccaaaaagacagttcatccctttgttttgaatatttgcctatctgttttttcactaaaaccaataaatccctttctctatagtttaatttattgaaagaaacattaaataatgattttgatggttcagtaaatttacttgaatataagttttaaaacagatatttcaataaaagacattaatttattttcttttcgaatattttcatcactatatagagatttatgtattgaacgaacattaaatataagatatattgatggctaatgatgatatggatggttttggaatttgcagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatga

SEQ ID NO: 1979 - DNA, 3197 bp, Arabidopsis thaliana
  G2019 DNA sequence used for BLAST
atggatcctgagacttatagggcagtggttatgggtaaggttcaagagtttgaaaaggttatggaggagaatgaaattcctgttcttgatcaggtcacttttcaggggaatacgattctgcatcttgcagctatttatggtcatgaccacctagtgcggcgtatccttgcctatgagctaaacattcttagaaattggaaacgtggcttaaattgcaacttcgtcccaagtttctctcattatcagactcttttggtgagacgaaactacaagggagaccttgctctccatgtagcagctgctgcaggacacaagttgatagttggccttcttattgattgcctaaggcagcttccgcaagatataactatggtgattggatcagagcaaatggtaattggaaacattttcagagtttccaacaatgatgggaatactgcattgcacctctccctgaaaggaaaccatgtatctgtttctttgcaacttgttcgtgaagatcgtagcacttgctttcttctggacaaggaggatgtatctccactgtatatggcagctgaagctggatatgtttcacttgtggagcatatgttacggggtttggatgcaagctttgttgggaaatccgttttgtgtgctgcagtgaaaagccagaatcttggtcagttttgtacattttgatccagtaaatttcatctttctcctatgaaaaaatgttaaagatcctttgtattcatttgttttttaatgtcaaggcagatatattgacagctgtattagagagtgactcagatctggtagaatcgagggatgaagatggaagaactccacttgccactgcagcatccattggttatgacattggagtgcagcatatgctaaccagatttgcaagttctacacaggttgcttacattaagaatgaagatggttctttccccatccactcagcctgcagtgctaggtgcacctcagctctcaaggtgatcttaaaacaccacccagacacaatagaaatgcttaactcacagggtcaaaacgttcttcatgtcgctgctaaaagcgggaatgcacgagctgttggctatctgctcagaaaatctgacgtcaaaaggttaatcaatgaacaagacatagaaggaaacacaccgttacatttagccagcagtaattctcatcccaaggttgtaagtctcttcatacatgatagaagagttgacttaaaaatactgaattacaaagggttcaccgctttagatgcagctgaggatcatatggcgacgattccttcactccaagaggtttggcctgcttttgtacggcattggatatatttgtactcatttatatgaagctgttgacatcactgaacatattctatgttatacccatttacagtggttgatatggatggcattggtggctgctggtaccactagagctccacgagttcatctgagagcagacatccctggtctgacaacagatgaggacttaatcctaaaaattcacaaggatagagtaaacactctccttgtggtggcaacactagtggctacaatggcttttgctgcaggcttgagtgtgccactaggttacaacagcacagagttcaagtcaaatgtcaaacattcttacgaagaatctgcatttcatgcttttgtcatctgcaatagcattgccgtatatactgctgttatatcgacagttgctcttatagggacacaattggctgacctaaaatgcatgctgaccaccttcaagtttattgtgccactcctggggttttctattatcgccatgtctttggcttttgttgcaggcttatacctggtcttgggacatcattattggcttgccatatttgtcttggcctcaggcggtttctatctcatggctctacttctgctcatcatcccttacgcttcgccttatacttttagtccgctattttttcgctactttttgcggtttcccttttcaatgttggtttcctttgcatactggagggatggcactgatggggaatgctcgtcacgagtttttcgttggtcatttcttggttaagaagatcaagacttgaaaattcctgaattcccttgtctcatgatgttttagcttgagtttgaattatgcggtgctggtagtagttaaattggtttcgggaagtttgccttaaaaaccacattgtatcttgcttcctaacatgtctcccatgagttgcaaagtgtattcttatgttgactaataaatactttcaactttttgttacagtggtgttattctcttactttctattgtggtaatcaatgaagctatgtagagaactcaattttcctttaacggcgaagaaagatatttaattagccattatggtctgaagcctctatgactagctctgatgtgtcttcattcatctgttgctgcattgacataattgttgctctttgcagcactatcaagaagcctgaattctttagtacagaatatgtcgaaggaagatgttgattccgtaaatcaactagttcctgcaccaacagaagagttgggtatgacttatatggagacgaatagggaacaaggagcagcatcaaaaccaacaggaagatgtcaccattaaccacgcaaagggaggtcgcttactgcaagatacattgccataaacgctattgacattgatgtaagcgaaaagaactggaagtgcgatgttgaaggcttttgagttgagagaaagatactattgtcatgatagaggaatacatcgccaatatgtcacatacaagaaagaattggaaagctgttttctgagccaaagtggccattcccaagttgggaacagagcctttgtgaccacctggtaatgtgaatcctgcagtaaaagtcatggtggttacaagagttgcaaccaataaacggaagaattgacatgatctttgtactttccaccttctggcttgaatgatctaagactttctgaaactggactggaacttcttggtgcaccagcattgatcaaagccatccaagtcaatcgctgtatacaaggtaatattggggtaacatctttgtcatattacctgttgaaacacgtagctccaatcaatgttctactacatctaaagctgtggaaccattatagtttggttttttcaggtcacctctatgatggtcccaagaaaacatactcacaactttag

SEQ ID NO: 1980 - DNA, 1409 bp, Arabidopsis thaliana
  G2484 cDNA Sequence
tatagggctagagcgccgcccgggcaggtgttttagggtttgtagctcctttctctttttttcttttctcaatttcccccaaattaaaaaaaaactctctctttcagagatttacaaatttcatttctccaaatccgaaaccccaaagtgaatatttttccttctgggtttcttttgtttgcctggaaacatttgtctcagattttgattttgaccggagtactcatattctccggcgatttctccggcgacatcgtttgtgaaatggagggaattactcatccaatacctcgtactgttgaagaggtctttagcgacttcagaggtcgacgagctggtcttattaaagctctcactaatgatatggtgaagttttaccaaacgtgtgatcctgagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggaagaggctgttccagatgattaatgagctgccaaccattttcgaagttgtgagcggcaatgcaaagcagtccaaggatctatctgttaacaacaataatagcaaaagcaaacctagtggcgtcaagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttgaagttaaataaccaaattatgaaaaggtaaagcgagttaggagaaaattatgaaagaagaaggtgaagtttccagtttataagaaatgccagtaaaagggacttagaagatgtaagcaggtaaaaaaaaaaattgtattgcttagtctttattgttggattgagactatctacagttggtgatgtcttttcttttctttttttggatttttgttgttgttaatgttaattctactactaatttgtttggtctgtttaagatattttagttctgattagtaattttttttttttttttttttctgattagtaatttgctaaaattgtaaaaactattatgtcgttatgtagtctttttattcatctttttaaaaaa

SEQ ID NO: 1981 - protein, 256 aa, Arabidopsis thaliana
  G2484 Amino Acid Sequence
MEGITHPIPRTVEEVFSDFRGRRAGLIKALTNDMVKFYQTCDPEKENLCLYGLPNETWEVNLPVEEVPPELPEPALGINFARDGMQEKDWVSLVAVHSDSWLLSVAFYFGARFGFGKNERKRLFQMINELPTIFEVVSGNAKQSKDLSVNNNNSKSKPSGVKSRQSESLSKVAKMSSPPPKEEEEEEDESEDESEDDEQGAVCGACGDNYGTDEFWICCDACEKWFHGKCVKITPAKAEHIKHYKCPTCSNKRARP

SEQ ID NO: 1982 - DNA, 1785 bp, Arabidopsis thaliana
  G2484 DNA sequence used for BLAST
atggagggaattactcatccaatacctcgtactgttgaagaggtctttagcgacttcagaggtcgacgagctggtcttattaaagctctcactaatggtcagttttggtctgattcttgtttctcacttgcgaatcagaatgataagtatctacagagttacgattttgtggcatttgggtttttcatttgttaaaaaagaagaactttttttattttgggtttcttttgtgagatttgacgattctgggttttgtgttttgtttatgcagatatggtgaagttttaccaaacgtgtgatcctggtgagttatttcttcacaacttttaaaaaattagtcttgcttagcttctatagtttctagtgaaatgttttgttgaagttgttgagcttgtatgttgttgaattgtgttggttaaagattgagttagttagtcctcctctgtgtggtttttctttaaggtgtttcattcttgtttatgtagagaaggagaatttgtgtctctatggacttccaaatgagacatgggaggttaatctacccgttgaggaagttcctcctgagcttcctgaaccagctttaggcatcaatttcgctagagacggaatgcaagaaaaggactgggtatctttggtcgcagttcacagtgattcatggctgctttctgttgcattttactttggtgcacgtttcggatttggcaagaatgagaggtaagggtccttctcaagctcagtgtttttgagtgttgcatctcaattatgacaatattgggtgtactcatgtgtggtaaggttataatgatcattctagcatcctcttgttttgtctatttgtctgatacaacaatctctgtgtggatttttgtaactcacgtgatcttatttatagggtcggtttctgtgtaactctttttgtaagtggttcccagtttctattttgaagtgactagagttatgaatcgcaccaatctggatcaatgttattgagatagatatattagtcaatagatgtgatatgtgcctctaagtctgattagtacttcttgtattagtcttgtgcaggatcactgtaattagcctaggtagtttccactgcattgtacctttgttgagagctcagcaacaatcactgaatccattatttgatactggtagctgacaggttaaacgaaaagcttgagcagaatgagttgttgattctgaatctcatcaaattcttctctggcattaggtttgtttgaacaacttagctatcacttgcctttaagcttatgccatggaccgattctttttcaggaagaggctgttccagatgattaatgagctgccaaccattttcgaagttgtgagcggcaatgcaaagcagtccaaggatctatctgttaacaacaataatagcaaaagcaaacctagtggcgtcaaggtatctcttctgtttcaccattttgttttatcaatctctgctaagttttatctctttgtattcctcacaaacagtctcgccaatccgaatctctctcaaaggttgcaaagatgtcatctccaccgccaaaagaagaagaagaagaagaagatgagagtgaagatgagagtgaagacgatgaacaaggtgcggtttgtggtgcttgtggagacaactacggtacagatgagttctggatttgctgcgacgcgtgtgagaaatggttccatggaaaatgtgtgaagataacacctgcaaaagcagaacacatcaagcattacaaatgcccaacttgcagtaacaagagagctagaccttga

SEQ ID NO: 1983 - DNA, 1456 bp, Arabidopsis thaliana
  G2741
gaaaaaaaaaaaaaaaaaaattgtttgctcatcatcttcacaaaccaaacttctcttcttctccgatctcagatttgaatttttatcgattttgagcttcgaagagctcaatctctaactgaatttcgagaaattagagagtttgaaatgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggtgcgtttgagtcaaatccttatatgatgcagcagaataagtttggatccatggcttcttatccttctgttggaggtggaagcgcaaatgagaattaaaaagagtctatagatggattcaatgggggaggaagagataggtgagcttgttattgctcgtggaactgataattattgtcaagtttctgtttttttaagtacagtacagttataattcttactcgatttgatcgaaattttcatcaagtttctgtcttttactataaatggtatacaataaagtcttaataatcacttgtgaggtgagtgccctcagatttatttgtctgcagacttcttaaagtggtaatcaagagagtgaattgtttatttctgtgagagatggcgtcagacacaaactttattttaaaaatttataaaccaatcaaatgtttca

SEQ ID NO: 1984 - protein, 323 aa, Arabidopsis thaliana
  G2741 polypeptide (domain in aa coordinates: 149-197)
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 1985 - DNA, 1236 bp, Glycine max
  G4243
atgggggaagaggtgaagacgagcgagtacgacgaagagcgcgtgatggagtgggagatgggtctcccaaccgccaacgatctcacgcctctctcccagccgctgatcccgccggagctcgcttcggccttcagcatctcgccggagccccaccgcaccctcctcgaggtcaaccgcgcctcgcgcaacacgctctccacaatccgcggcggcggtagcgtgcaccaggccttctcatccaacaacaacaacaaccaccactacgacggcgacggagacggcggcgacgaggaggagtacgacgacgccgatcgcgatggctcggggtcggattcccggaagcagcggaagatcgactgcggcgtggcggaggaggcggactcggcggtgcggacagagacctcggcggagcgaacggcggtgaagcggccgcggctggtgtggaccccgcagcttcacaagaggttcgtggacgtggtggcgcacctcgggatcaagaacgcggtgccgaagacgattatgcaattgatgaacgtggaagggttgacccgcgagaatgtcgcgagccatctccagaagtatcgtctctacctgaaacggatgcagggcctttcgaacgagggcccttcttcttcggatcagttattcgcttccacagctgtgcctcagagtttgcatgactctgctcctcccagtgcccatagcaatggccatggtcatctccctgttcccatgatgtccatgccatatccccctcccatgatgtccatgccatacccccctcccatgatgtccggcatgccccatgcccatggccacatgggcatccccatgcctaattcctccgccacctcagcttaccatccttataacatgttgcatcaaagggattggcctcaccttgctcctaatgataaatgaacctccaagattcaaaggcttgattattggtggtgtgtaattcacaccctgtaattcacattgatgattaccttgtaattcacacaaatggattattgaggaagtatatgaacaatactatatggagctagattacaatctgaatcagtagtgtgtaaccctgtgggagatttacaaacatattggtacacatctctaattcctgtcacctaattgtatgacgagaattctggcttatttcttctggtctgcctagacagctgattctaaagttaattcttaactagttctctgattcataaaaaaaaaaaaaaa

SEQ ID NO: 1986 - protein, 306 aa, Glycine max
  G4243 polypeptide (domain in aa coordinates: 148-196)
MGEEVKTSEYDEERVMEWEMGLPTANDLTPLSQPLIPPELASAFSISPEPHRTLLEVNRASRNTLSTIRGGGSVHQAFSSNNNNNHHYDGDGDGGDEEEYDDADRDGSGSDSRKQRKIDCGVAEEADSAVRTETSAERTAVKRPRLVWTPQLHKRFVDVVAHLGIKNAVPKTIMQLMNVEGLTRENVASHLQKYRLYLKRMQGLSNEGPSSSDQLFASTAVPQSLHDSAPPSAHSNGHGHLPVPMMSMPYPPPMMSMPYPPPMMSGMPHAHGHMGIPMPNSSATSAYHPYNMLHQRDWPHLAPNDK

SEQ ID NO: 1987 - DNA, 1599 bp, Glycine max
  G4244
tgtttcacacacatatatactctctctctctctctctctctctctctctctgtttgggttagggacatagaagaagagtgtgtgagagagacacggttaaatttgttttgttttatatacggttagaactaactgaatgggggaagaggtgaagacgagcgagtacgacgaagagcgcgtgatggagtgggaggcgggtctcccaactgccaacgatctcacgcctctctctcagccgctgatcccgccggaactcgcgtcggccttcagcatcttgccggagccccaccgcaccctcctcgacgtcaaccgcgcctctcgcaacacgctctccacgctccgcggcggcggagggagcgtgcaccaggccttctcctcctccaacaacaaccacaactacgacggcgacggcgacggaggcgtcgaggaggaggaggaggaggacgacgatcgcgacggctcggggccggattcacggaagcagcggaagatcgactgcggcgcggccgaggaggcggactcggcggttcagacggagacctcggcggagcggacggcggtgaagcggccgcggctggtgtggaccccacagcttcacaagaggttcgttgacgtggtggcgcacctcgggatcaagaacgcggtgccgaagacgattatgcaattgatgaacgtggaagggttgacccgcgagaatgtcgcaagccatctccagaagtatcgtctctacctgaaacggatgcagggtctctccaacgagggtccttctgcttcggatcagttatttgcgtcgacacctgtgcctcagagcttgcatgactctgctcctcccagtaaccatagcaatggtcatgggcatgggcatggccatagcaatggccgtggtcatggtcatggtcatggtcatggtcatctctctgttccgatgatgtccatgccatatccacctcccctgatgtccatgccatatccacctcccatgatgtcgggcatgccccatggccacatgggcatccccatgcctaattcctccgccacctcagcttaccatccttataatatgttgcatcaaagggattggcctcaccttgctcctaatgataaatgaacctataaggtcagccatcaccatcatatgcaaaagattcaaaggcttgattattggtagtatagctttctgagaagggaggagctgcattgatgattaccctgtaattcactcaaaaggattattgaggaagtatatgaagaagagtatatggagctagattacaatcttagtcagtagtgtgtatcctgtgggagatttacaaacttattggtacacatctctaattcctgtcacctaattgtatgacgagaattctggcttatttcttctggtctgcctagacagctgattctaaagtaaattcttaactggttctctgattcataaattatagattcctattatattgtgtaatcctgaatgtgttaactctctttttcagaaccattgaataaaagaaagaccgaacaacagacaggaaacatttattggttgctctggccttaaatgttcttctttttcttatacctcttgatcattatttcctt

SEQ ID NO: 1988 - protein, 323 aa, Glycine max
  G4244 polypeptide (domain in aa coordinates: 149-197)
MGEEVKTSEYDEERVMEWEAGLPTANDLTPLSQPLIPPELASAFSILPEPHRTLLDVNRASRNTLSTLRGGGGSVHQAFSSSNNNHNYDGDGDGGVEEEEEEDDDRDGSGPDSRKQRKIDCGAAEEADSAVQTETSAERTAVKRPRLVWTPQLHKRFVDVVAHLGIKNAVPKTIMQLMNVEGLTRENVASHLQKYRLYLKRMQGLSNEGPSASDQLFASTPVPQSLHDSAPPSNHSNGHGHGHGHSNGRGHGHGHGHGHLSVPMMSMPYPPPLMSMPYPPPMMSGMPHGHMGIPMPNSSATSAYHPYNMLHQRDWPHLAPNDK

SEQ ID NO: 1989 - DNA, 1128 bp, Lycopersicon esculentum
  G4245
cttcattcaacggcatctctctcaaattcgccggaatatactccaccagcggaagaagattgtagtacttgcaaatactgttaccatgggtgaagaagtgagcctgaccgactatgaatcaagcggtggtaacgatgacagacttctctgggaaattggacttcccgatgtcgatgatctcacaccgttgaatatgcagttgattccgtcggaacttgctgctgcgttcagaatttcgccggaattgtcaaagacgatgaccgatgtaaatcgtgcttcgcagaatacgttttcttctctccagagatggcactcacaggatatggcttcgatgaataactctaatttcaagacgtttagctatgagaggagtagagaagagactgttactgaaagagatgaaacggatctgataagagagggatccgactcgaggaagctccggcgggttgaatccggaggcactgaggaggctgattcatctctgtgtaacgagaattttgcggatgattcgtctgctaagactctgaaacggcccagacttgtttggacgccgcagttacacaagcgctttattgaagtagtggcgcacttaggtatcaaaggggctgtgccgaaaacaattatgcagcttatgaatgtggaaggattgacgagagagaacgtagcaggtcatttacagaaatacagattgtatacgaagagaatgcagccgaacgagggtccttcttcgtctgatcatttgttgacttccacaccggctacagagattatgcgtgagtccagtgagagtggtcacctccgcaatactaatggccacatggcaatgccaactctgatgccgtaccaacaacaaatggtggcgatgccaatgatggggatgccaaatggaggacatgtaggcatgcctgttggttacgggggtggaccgccacttgggtttcatcatcactataatgtggtgcaacagcgggattggtctggaaataattttggttactatcatcctgttgcttctaatgataagtagctccacaagctgggacctggatgatgtcatttgatcgtggaggaatcatggcaggttcatgaagtgttgttctctggtaaaatgtgggacaaatatga

SEQ ID NO: 1990 - protein, 314 aa, Lycopersicon esculentum
  G4245 polypeptide (domain in aa coordinates: 155-203)
MGEEVSLTDYESSGGNDDRLLWEIGLPDVDDLTPLNMQLIPSELAAAFRISPELSKTMTDVNRASQNTFSSLQRWHSQDMASMNNSNFKTFSYERSREETVTERDETDLIREGSDSRKLRRVESGGTEEADSSLCNENFADDSSAKTLKRPRLVWTPQLHKRFIEVVAHLGIKGAVPKTIMQLMNVEGLTRENVAGHLQKYRLYTKRMQPNEGPSSSDHLLTSTPATEIMRESSESGHLRNTNGHMAMPTLMPYQQQMVAMPMMGMPNGGHVGMPVGYGGGPPLGFHHHYNVVQQRDWSGNNFGYYHPVASNDK

SEQ ID NO: 1991 - DNA, 1243 bp, Oryza sativa
  G4241
ccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggaggcggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggctgcggcgcgcgtcgtcgtcgtcgtcgagctcgttcccggcgttcgcgtcgaagggagcgggagcgggagcggacgaggcggagtcagggggaggcgcgaatggggggaacgggaacaccaacaacaacagcagcaagagggcgcggctggtgtggaccccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgaccaggttccttctccttaccacccccacccccaccaccactcctacaacaacgccgcctatgccgccaccgtctcctcctaccaccactaccaccacgccaaccactgatccattccttctcatcatcatttcatttccacatctatataccacatactactccataacgaaggtgtttcatcaataagagaagagaagagaagagaatgctccctcaactgtaaactcctaattctaattaagggcaaagtgtatccatccatccatccacgctgtttgtttgtagctgttgttaattgagctggatgcatgacatgtatctctatgtacctacctgcgtgacaaaggcatcatgcatatgtatggttcccttgcaatttggggaatccagaaatgattcatacttgtgattcttgc

SEQ ID NO: 1992 - protein, 238 aa, Oryza sativa
  G4241 polypeptide (domain in aa coordinates: 123-171)
MGEEAPEEYELGGGEDERVMEWEAGLPGADELTPLSQPLVPAGLAAAFRIPPEPGRTLLDVHRASAATVSRLRRASSSSSSSFPAFASKGAGAGADEAESGGGANGGNGNTNNNSSKRARLVWTPQLHKRFVEVVAHLGMKNAVPKTIMQLMNVEGLTRENVASHLQKYRLYVKRMQGLSNEGPSPSDHIFASTPVPHASLHDQVPSPYHPHPHHHSYNNAAYAATVSSYHHYHHANH

SEQ ID NO: 1993 - DNA, 1003 bp, Zea mays
  G4240
atctccgacccgatccgacccgacacacaaatatctccacccctgttccggcgacgactacgatttgggaggaaggtaagcgaatgggtgaggaggcggtcgacgactacgagctccacatggtgtgctacggcggcggcggcggcggcagcgaggacgagcgcgtgatggagtgggagtcaggtctcccgggcgcggacgagctgaccccgctgtcgcagccgctggtgccggcgggtctggcagcggcgttccgcatcccgccggaggccgggcggacgctgctggacgtgcaccgcgcgtcggctgccacggtgtcccggctgcgtcgcgcgccgccgccgtcgtcgtcgggcagcggagggagctcctccttcgcgcccttccatccggcggcgaggggggacgaaggggcggactcgtcggcggcgggcggcggggcggcggcgacgacgaacggcaacaataacatgagcagcagcagcaagcggccccggctggtgtggacgccgcagctgcacaagcggttcgtggacgtggtggcgcacctggggatgaagaacgcggtgcccaagaccatcatgcagctgatgaacgtggaagggctgacgcgggagaacgtggccagccacctgcagaagtaccgcctctacgtcaagcggatgcagggcctctccgacgagggcccgtcgccgtccgaccacatcttcgcatccacgccggtgccgcaaagcctggtgcatgaggtgcccatgtacggcaccatggccagcggcggacaggcgtaccacaaccacaacggaatgggaggaggagggtaccagtaccagtaccatcactaccaccacgcccacaaatgactcttctgttggattggatccctcaataatcccatcgatccttttggttttggatctcttgctaattcagttcttcgtgtgagcggtaaatggatctcttttaagaaataaagaaagaaagataagtttcttttcccttttca

SEQ ID NO: 1994 - protein, 258 aa, Zea mays
  G4240 polypeptide (domain in aa coordinates: 141-189)
MGEEAVDDYELHMVCYGGGGGGSEDERVMEWESGLPGADELTPLSQPLVPAGLAAAFRIPPEAGRTLLDVHRASAATVSRLRRAPPPSSSGSGGSSSFAPFHPAARGDEGADSSAAGGGAAATTNGNNNMSSSSKRPRLVWTPQLHKRFVDVVAHLGMKNAVPKTIMQLMNVEGLTRENVASHLQKYRLYVKRMQGLSDEGPSPSDHIFASTPVPQSLVHEVPMYGTMASGGQAYHNHNGMGGGGYQYQYHHYHHAHK

SEQ ID NO: 1995 - protein, 49 aa, Arabidopsis thaliana
  G1435 conserved domain
WTPQLHKRFVDVVAHLGIKNAVPKTIMQLMNVEGLTRENVASHLQKYRL

SEQ ID NO: 1996 - protein, 49 aa, Arabidopsis thaliana; identical to SEQ ID NO: 1995
  G2741 conserved domain

SEQ ID NO: 1997 - protein, 49 aa, Glycine max; identical to SEQ ID NO: 1995
  G4243 conserved domain

SEQ ID NO: 1998 - protein, 49 aa, Glycine max; identical to SEQ ID NO: 1995
  G4244 conserved domain

SEQ ID NO: 1999 - protein, 49 aa, Lycopersicon esculentum
  G4245 conserved domain
WTPQLHKRFIEVVAHLGIKGAVPKTIMQLMNVEGLTRENVAGHLQKYRL

SEQ ID NO: 2000 - protein, 49 aa, Oryza sativa
  G4241 conserved domain
WTPQLHKRFVEVVAHLGMKNAVPKTIMQLMNVEGLTRENVASHLQKYRL

SEQ ID NO: 2001 - protein, 49 aa, Zea mays
  G4240 conserved domain
WTPQLHKRFVDVVAHLGMKNAVPKTIMQLMNVEGLTRENVASHLQKYRL

SEQ ID NO: 2002 - protein, 8 aa, Arabidopsis thaliana
  GARP domain consensus motif
SHLQKYRL

What is claimed is:

1. A transgenic plant transformed with an expression vector comprising a polynucleotide sequence encoding a polypeptide having a conserved domain that has at least 85% sequence identity to amino acids 145-213 of SEQ ID NO: 163, wherein a plant transformed with the expression vector exhibits increased resistance to a fungal pathogen when compared to a control plant.

2. The transgenic plant of claim 1, wherein the conserved domain is at least 91% identical to the conserved domain of amino acids 145-213 of SEQ ID NO: 163.

3. The transgenic plant of claim 1, wherein the conserved domain is at least 95% identical to amino acids 145-213 of SEQ ID NO: 163.

4. The transgenic plant of claim 1, wherein the conserved domain is at least 97% identical to amino acids 145-213 of SEQ ID NO: 163.

5. The transgenic plant of claim 1, wherein expression of the polypeptide is regulated by a constitutive, inducible, or tissue-specific promoter.

6. The transgenic plant of claim 1, wherein the fungal pathogen is *Botrytis*.

7. The transgenic plant of claim 1, wherein the fungal pathogen is *Erysiphe*.

8. The transgenic plant of claim 1, wherein the fungal pathogen is *Sclerotinia*.

9. The transgenic plant of claim 1, wherein the transgenic plant is a transgenic seed comprising the expression vector of claim 1.

10. The transgenic plant of claim 1, wherein the transgenic plant produces a greater yield than the control plant.

11. A method for producing a transgenic plant having greater resistance to a fungal pathogen than a control plant comprising transforming a target plant with a recombinant construct encoding a polypeptide having a conserved domain at least 85% identical to amino acids 145-213 of SEQ ID NO: 163, wherein a plant transformed with the recombinant construct exhibits increased resistance to a fungal pathogen when compared to the control plant.

12. The method of claim 11, wherein the conserved domain is at least 91% identical to amino acids 145-213 of SEQ ID NO: 163.

13. The method of claim 11, wherein the conserved domain is at least 95% identical to amino acids 145-213 of SEQ ID NO: 163.

14. The method of claim 11, wherein the conserved domain is at least 97% identical to amino acids 145-213 of SEQ ID NO: 163.

15. The method of claim 11, wherein expression of the polypeptide is regulated by a constitutive, inducible, or tissue-specific promoter.

16. The method of claim 11, wherein the fungal pathogen is *Botrytis*.

17. The method of claim 11, wherein the fungal pathogen is *Erysiphe*.

18. The method of claim 11, wherein the fungal pathogen is *Sclerotinia*.

19. The method of claim 11, wherein the transgenic plant produces a greater yield than the control plant.

20. A transgenic plant comprising a recombinant polynucleotide encoding a polypeptide with at least 85% amino acid sequence identity to SEQ ID NO:163, and wherein a plant transformed with the recombinant polynucleotide exhibits increased resistance to a fungal pathogen when compared to a control plant.

21. The transgenic plant of claim 20, wherein the polypeptide is at least 90% identical to SEQ ID NO: 163.

22. The transgenic plant of claim 20, wherein the polypeptide is at least 95% identical to SEQ ID NO: 163.

23. A method for producing a transgenic plant having greater resistance to a disease than a control plant, the method comprising the step of transforming a target plant with a recombinant construct encoding a polypeptide that is at least 85% identical to SEQ ID NO: 163, wherein a plant transformed with the recombinant construct exhibits increased resistance to a fungal pathogen when compared to the control plant.

24. The method of claim 23, wherein the polypeptide is at least 90% identical to SEQ ID NO: 163.

25. The method of claim 23, wherein the polypeptide is at least 95% identical to SEQ ID NO: 163.

* * * * *